(12) United States Patent
Thompson et al.

(10) Patent No.: US 8,969,033 B2
(45) Date of Patent: Mar. 3, 2015

(54) ALTERATION AND MODULATION OF PROTEIN ACTIVITY BY VARYING POST-TRANSLATIONAL MODIFICATION

(75) Inventors: David N. Thompson, Idaho Falls, ID (US); David W. Reed, Idaho Falls, ID (US); Vicki S. Thompson, Idaho Falls, ID (US); Jeffrey A. Lacey, Idaho Falls, ID (US); William A. Apel, Jackson, WY (US)

(73) Assignee: Battelle Energy Alliance, LLC, Idaho Falls, ID (US)

( * ) Notice: Subject to any disclaimer, the term of this patent is extended or adjusted under 35 U.S.C. 154(b) by 673 days.

(21) Appl. No.: 12/655,993

(22) Filed: Jan. 12, 2010

(65) Prior Publication Data

US 2010/0203583 A1 Aug. 12, 2010

Related U.S. Application Data

(63) Continuation-in-part of application No. 12/380,450, filed on Feb. 26, 2009, and a continuation-in-part of application No. 11/266,063, filed on Nov. 2, 2005, now Pat. No. 7,727,755.

(51) Int. Cl.
| | |
|---|---|
| C12P 21/06 | (2006.01) |
| C12N 9/24 | (2006.01) |
| C12N 9/42 | (2006.01) |
| C12N 9/10 | (2006.01) |
| C12N 9/12 | (2006.01) |
| C12P 21/00 | (2006.01) |

(52) U.S. Cl.
CPC ............ *C12N 9/1048* (2013.01); *C12N 9/1051* (2013.01); *C12N 9/1288* (2013.01); *C12P 21/00* (2013.01); *C12P 21/005* (2013.01); *C12Y 302/01004* (2013.01); *C12Y 302/01008* (2013.01); *C12N 9/2402* (2013.01); *C12N 9/2437* (2013.01); *C12N 9/2477* (2013.01); *C12N 9/2482* (2013.01)
USPC .......... 435/68.1; 435/69.1; 435/200; 435/209

(58) Field of Classification Search
None
See application file for complete search history.

(56) References Cited

U.S. PATENT DOCUMENTS

| | | | |
|---|---|---|---|
| 4,237,226 A | 12/1980 | Grethlein | |
| 4,581,333 A | 4/1986 | Kourilsky et al. | |
| 4,624,922 A | 11/1986 | Horikoshi et al. | |
| 5,098,825 A | 3/1992 | Tchen et al. | |
| 5,882,905 A | 3/1999 | Saha et al. | |
| 5,916,795 A | 6/1999 | Fukunaga et al. | |
| 5,948,667 A | 9/1999 | Cheng et al. | |
| 6,083,733 A | 7/2000 | Gronberg et al. | |
| 6,268,197 B1 | 7/2001 | Schulein et al. | |
| 6,426,211 B1 | 7/2002 | De Buyl et al. | |
| 6,506,585 B2 | 1/2003 | Danielsen et al. | |
| 6,777,212 B2 | 8/2004 | Asakura et al. | |
| 6,833,259 B2 | 12/2004 | Bhosle et al. | |
| 7,727,755 B2 | 6/2010 | Thompson et al. | |
| 8,071,748 B2 | 12/2011 | Thompson et al. | |
| 2003/0134395 A1 | 7/2003 | Shetty | |
| 2003/0233675 A1 | 12/2003 | Cao et al. | |
| 2004/0029129 A1 | 2/2004 | Wang et al. | |
| 2005/0112742 A1 | 5/2005 | Thompson et al. | |
| 2006/0105442 A1 | 5/2006 | Wu et al. | |
| 2006/0211083 A1 | 9/2006 | Katzen et al. | |
| 2007/0082381 A1 | 4/2007 | Wilting et al. | |
| 2007/0134778 A1 | 6/2007 | Benning et al. | |
| 2007/0148728 A1 | 6/2007 | Johnson et al. | |
| 2009/0203107 A1 | 8/2009 | Thompson et al. | |
| 2009/0215168 A1 | 8/2009 | Lee et al. | |
| 2009/0221049 A1 | 9/2009 | Shaw et al. | |
| 2009/0226978 A1 | 9/2009 | Thompson et al. | |
| 2009/0253205 A1 | 10/2009 | Thompson et al. | |
| 2009/0263859 A1 | 10/2009 | Thompson et al. | |
| 2009/0269827 A1 | 10/2009 | Thompson et al. | |
| 2010/0311110 A1 | 12/2010 | Thompson et al. | |
| 2011/0081683 A1 | 4/2011 | Thompson et al. | |
| 2011/0275135 A1 | 11/2011 | Lee et al. | |

FOREIGN PATENT DOCUMENTS

| | | |
|---|---|---|
| DE | 197 17 893 A1 | 1/1999 |
| WO | 81/00577 | 3/1981 |
| WO | 99/06584 A1 | 2/1999 |
| WO | 03/068926 A2 | 8/2003 |
| WO | 2005/066339 A2 | 7/2005 |
| WO | 2006/117247 A1 | 11/2006 |

OTHER PUBLICATIONS

Bork, Peer, "Powers and Pitfalls in Sequence Analysis: The 70% Hurdle," Genome Research, 2000, 10:398-400.
Bowie et al., "Deciphering the Message in Protein Sequences: Tolerance to Amino Acid Substitutions," Science, 1990, 247:1306-1310.
Lau et al., "PCR ligation mutagenesis in transformable streptococci: application and efficiency," Journal of Microbiological Methods 49 (2002) 193-205.
Schwarz, Wolfgang H., "A list of cellulolytic bacteria," Technische Universitat Munchen, Apr. 24, 2003, 8 pages.
Simpson et al., "An extremely Thermostable xylanase from the thermophilic eubacterium *Thermotoga*," Biochem. J. (1991) 277, 413-417.
Smook, G.A., "Handbook for Pulp & Paper Technologists," Tappi Pr; 2nd Ed. (Jun. 1992) pp. 65-88.
Subramaniyan et al., "Cellulase-free xylanases from *Bacillus* and other microorganisms," FEMS Microbiology Letters 183 (2000) 1-7.

(Continued)

*Primary Examiner* — Robert A Zeman
(74) *Attorney, Agent, or Firm* — TraskBritt

(57) ABSTRACT

Embodiments of the invention include methods of altering the enzymatic activity or solubility of an extremophilic enzyme or post-translationally modifying a protein of interest via using isolated or partially purified glycosyltransferases and/or post-translational modification proteins, extracts of cells comprising glycosyltransferases and/or post-translational modification proteins, and/or in cells comprising one or more glycosyltransferases and/or post-translational modification proteins.

2 Claims, 37 Drawing Sheets

(56) References Cited

OTHER PUBLICATIONS

Sunna et al., "Glycosyl hydrolases from hyperthermophiles," Extremophiles (1997) 12-13.
Techapun et al., "Production of a cellulose-free xylanase from agricultural waste materials by a thermotolerant *Streptomyces* sp.," Biotechnology Letters 23: 1685-1689, 2001.
Thompson et al., "Comparison of Pretreatment Methods on the Basis of Available Surface Area," Bioresource Technology 39 (1992) 155-163.
Thompson et al., "In Vitro Degradation of Natural Insoluble Lignin in Aqueous Media by the Extracellular Peroxidases of *Phanerochaete chrysosporium*," 1998 John Wiley & Sons, Inc. pp. 704-717.
Thompson et al., "Measurement of fumonsins in corn with a fiber-optic fluoroimmunosensor," SPIE vol. 2980, (2010) pp. 532-538.
Thompson et al., "Preliminary Investigation of Fungal Bioprocessing of Wheat Straw for Production of Straw-Thermoplastic Composites," Applied Biochemistry and Biotechnology, vol. 105-108, 2003, pp. 423-436.
Thompson et al., "Purification and Characterization of a Novel Thermo-Alkali-Stable Catalase from *Thermus brockianus*," Biotechnol. Prog. 2003, 19, 1292-1299.
Thompson et al., "Thermoacidophilic Cellulases and Hemicellulases from *Alicyclobacillus acidocaldarius*," Idaho National Laboratory, 2006, 1 page.
Thompson, et al., "Chapter 31: Changes in the Rate of Enzymatic Hydrolysis and Surface Area Available to Cellulase with Pretreatment Methods," Biotechnology in Pulp and Paper Manufacture: Applications and Fundamental Investigations. Proceedings of the Fourth International Conference on Biotechnology in the Pulp and Paper Industry (ICBPPI), May 16-19, 1989,Raleigh, NC and Myrtle Beach, SC, USA. Kirk, T.K. and Chang, H.M. (eds.). Butterworth-Heinemann, Boston, 1990, pp. 329-338.
Tsao, G.T., "Bacterial Hydrolysis: A Review," Anaerobic Digestion and Carbohydrate Hydrolysis of Waste, Ferrero et al. (eds.), Elsevier Applied Science Publishers, London, 1984, pp. 83-99.
Turner et al., "Potential and utilization of thermophiles and thermostable enzymes in biorefining," Microbial Cell Factories, Biomed Central, London, NL, vol. 6, No. 1, Mar. 15, 2007, p. 9.
Uhl et al., "The first description of an archaeal hemicellulase: the xylanase from *Thermococcus zilligii* strain AN1," Extremophiles (1999) 3:263-267.
Viikari et al., "Xylanases in bleaching: From an idea to the industry," FEMS Microbiology Reviews 13 (1994) 335-350.
Walseth, Curtis S., Occurrence of Cellulases in Enzyme Preparations from Microorganisms, TAPPI vol. 35, No. 5, May 1952, pp. 228-233.
Ward et al., "Characterization of a new bacteriophage which infects bacteria of the genus *Acidiphilium*," Journal of General Virology (1993) 74: 2419-2425.
Ward et al., "Electrotransformation of Acidophilic, Heterotrophic, Gram-negative Bacteria," Electrotransformation of Bacteria, Natalie Eynard, Justin Teissie (eds.), Springer (2000) pp. 94-103.
Wright et al., "Ethanol from Biomass by Enzymatic Hydrolysis," Chemical Engineering Progress, Aug. 1988, pp. 62-74.
Yuan et al., "Expression of acidophilic alpha-amylase from *Alicyclobacillus acidocaldarius*, Sheng Wu Gong Cheng Xue Bao, Jan. 2005, 21(1):78-83. Abstract only.
Barany, F., 1911, PNAS. USA, 88: 189-193.
Bertoldo et al., 2004, Eng. Life Sci., 4, No. 6.
BLAST Search of Seq. ID. 36, accessed Apr. 22, 2009, 54 pages.
BLAST Search of Seq. ID. 456, accessed Apr. 22, 2009, 48 pages.
BLAST Search of Seq. ID. 458, accessed Apr. 22, 2009, 59 pages.
BLAST Search of Seq. ID. 460, accessed Apr. 22, 2009, 37 pages.
BLAST Search of Seq. ID. 462, accessed Apr. 22, 2009, 35 pages.
BLAST Search of Seq. ID. 464, accessed Apr. 22, 2009, 45 pages.
Borman, S., 2006, Glycosylation Engineering. Chem. Eng. News, 84(36): 13-22.
Buckholz, R. G., 1993, Yeast systems for the expression of heterologous gene products. Curr. Op. Biotechnology 4: 538-542.
Burg, J. L. et al., 1996, Mol. and Cell. Probes, 10: 257-271.
Chu, B. C. F. et al., 1986, NAR, 14: 5591-5603.
Collins et al., "Xylanases, Xylanase Families and Extremophilic Xylanses," FEMS Microbiology Review, 2005, pp. 3-23.
Duck, P. et al., 1990, Biotechniques, 9: 142-147.
Eckert et al., "Gene cloning, sequencing, and characterization of a family 9 endoglucanase (CelA) with an unusual pattern of activity from the theremoacidophile *Alicyclobacillus acidocaldarius* ATCC27009," Applied Microbiology and Biotechnology, vol. 60, No. 4, Dec. 2002, pp. 428-436.
Eckert, Kelvin, "Dissertation, Cloning and Characterization of two glycosidases from the acidothermophile *Alicyclobacillus acidocaldarius* ATCC27009," Berlin, Dec. 18, 1971, 113 pages.
Eckert et al., "A Thermoacidophilic Endoglucanase (CelB), etc.," Eur. J. Biochem. 270, 2003, pp. 3593-3602.
Edwards, C. P., and Aruffo, A., 1993, Current applications of COS cell based transient expression systems. Curr. Op. Biotechnology 4: 558-563.
Erlich, H.A., J Clin. Immunol., Nov. 1989; 9(6):437-47.
Garrote, G, H Dominguez, and JC Parajo, 2001, Manufacture of xylose-based fermentation media from corncobs by posthydrolysis of autohydrolysis liquors, Appl. Biochem. Biotechnol., 95:195-207.
Guateli, J. C. et al., 1990, PNAS. USA, 87: 1874-1878.
Hamelinck, CN, G van Hooijdonk, and APC Faaij, 2005, Ethanol from lignocellulosic biomass: techno-economic performance in short-, middle-, and long-term, Biomass Bioenergy, 28:384-410.
Huygen, K. et al., 1996, Nature Medicine, 2(8): 893-898.
Lin et al., "Purification, Characterization, and Gene Cloning of Thermopsin, a Thermostable Acid Protease from *Sulfolobus acidocaldarius*," The Journal of Biological Chemistry, 1990, vol. 265, No. 3, pp. 1490-1495.
PCT International Search Report and Written Opinion of the International Search Authority for PCT/US10/25521, dated Jul. 14, 2010, 12 pages.
Aden et al., "Lignocellulosic Biomass to Ethanol Process Design and Economics Utilizing Co-Current Dilute Acid Prehydrolysis and Enzymatic Hydrolysis for Corn Stover," NREL/TP-510-32438, National Renewable Energy Laboratory, Golden Colorado. Jun. 2002, pp. 1-88.
Avella et al., "A New Class of Biodegradable Materials: Poly-3-hydroxy-butyrate/Steam Exploded Straw Fiber Composites. I. Thermal and Impact Behaviour," Journal of Applied Polymer Science, vol. 49, 2091-2103 (1993).
Badger, P.C., "Ethanol from cellulose: A general review," In: J. Janick and A. Whipkey (eds.), Trands in new crops and new uses. ASHS Press, Alexandria, VA, 2002, pp. 17-21.
Bailey et al., "Interlaboratory testing of methods for assay of xylanase activity," Journal of Biotechnology, 23 (1992) 257-270.
Bergquist et al., "Molecular diversity of thermophilic cellulolytic and hemicellulolytic bacteria," FEMS Microbiology Ecology 28 (1999) 99-110.
Cowling, Ellis B., "Physical and Chemical Constrains in the Hydrolysis of Cellulose and Lignocellulosic Materials," Biotechnol. & Bioeng. Symposium No. 5, 163-181 (1975).
Crout et al., "Glycosidases and glycosyl transferases in glycoside and oligosaccharide synthesis," Current Opinion in Chemical Biology, Current Biology Ltd, London, GB, vol. 2, No. 1, Feb. 1, 1998, pp. 98-111.
Dale, M. Clark, "Enzymatic simultaneous saccharification and fermentation (SSF) of biomass to ethanol in a pilot 130 liter multistage continuous reactor separator," Bio-Process Innovation, Inc., W. Lafayette, IN, 2005, 10 pages.
Database UniProt [Online]. Feb. 10, 2009. XP-000002659383. Database accession No. B7DT70, 1 page.
Ehrman, Tina, "Standard Method for Determination of Total Solids in Biomass," Chemical Analysis and Testing Task, Laboratory Analytical Procedure, Oct. 28, 1994, 242 total pages.
EMBL Submission CP001728, Sep. 2009. [Retrieved from the internet: URL:http://www.ebi.ac.uk/Tools/dbfetch/embifetch?style=html&id=CP001728&Submit=Go], 51 pages.
Extended Supplementary European Search Report for EP 09 82 3952, dated Sep. 20, 2011, 7 pages.

(56) References Cited

OTHER PUBLICATIONS

Fan et al., "The Nature of Lignocellulosics and Their Pretreatments for Enzymatic Hydrolysis," Advances in Biochemical Engineering/Biotechnology, 1982, vol. 23/1982, 157-187.
Flanagan, et al., "Development of gas phase bioreactors for the removal of nitrogen oxides from synthetic flue gas streams," Fuel 81 (2002) 1953-1961.
Fushinobu et al., "Crystallographic and mutational analyses of an extremely acidophilic and acid-stable xylanase: biased distribution of acidic residues and importance of Asp37 for catalysis at low pH," Protein Engineering vol. 11, No. 12, pp. 1121-1128, 1998.
Gessesse, Amare, "Purification and Properties of Two Thermostable Alkaline Xylanases from an Alkaliphilic *Bacillus* sp.," Applied and Environmental Microbiology, Sep. 1998, pp. 3533-3535.
Glenn et al., "Transformation of *Acidiphilium* by electroporation and conjugation," Can J Microbiol. May 1992;38 (5):387-93.
Goldstein et al. "The Hydrolysis of Cellulose with Superconcentrated Hydrochloric Acid," Biotechnology and Bioengineering Symp. No. 13, pp. 17-25 (1983).
Grassin et al., "Chapter 2.13, Fruit Juices," (T. Godfrey and S. West, eds.), Industrial Enzymology, 2nd Ed., pp. 227-264 (1996).
Grethlein, H. E., "Pretreatment for enhanced hydrolysis of cellulosic biomass," Biotechnol. Adv. 1984. 2:43-62.
Grethlein, Hans E., "Comparison of the Economics of Acid and Enzymatic Hydrolysis of Newsprint," Biotechnology and Bioengineering, vol. XX, pp. 503-525 (1978).
Hanselmann, K.W., "Lignochemicals," Experientia 38 (1982) pp. 176-189.
Houghton et al., "Fungal Upgrading of Wheat Straw for Straw-Thermoplastics Production," Applied Biochemistry and Biotechnology, vol. 113-116, 2004, pp. 71-93.
Keller et al., "Microbial Pretreatment of Biomass: Potential for Reducing the Severity of Thermochemical Biomass Pretreatment," Applied Biochemistry and Biotechnology, vol. 105-108, 2003.
Kenealy et al., "Rapid 2,2-bicinchoninic-based xylanase assay compatible with high throughput screening," Biotechnology Letters 25: 1619-1623, 2003.
Knappert et al., "Partial Acid Hydrolysis of Cellulosic Materials as a Pretreatment for Enzymatic Hydrolysis," Biotechnology and Bioengineering, vol. XXII, pp. 1449-1463 (1980).
Kulkarni et al., "Molecular and biotechnological aspects of xylanases," FEMS Microbiology Reviews 23 (1999) 411-456.
Lauro et al., "Characterization of a β-glycosidase from the thermoacidophilic bacterium *Alicyclobacillus acidocaldarius*," Extremophiles (2006) 10:301-310.
Lee et al., "Oxygen Effects on Thermophilic Microbial Populations in Biofilters Treating Nitric Oxide Containing Off-Gas Streams," Environmental Progress, vol. 20, No. 3, Oct. 2001.
Lynd, Lee R., "Overview and Evaluation of Fuel Ethanol from Cellulosic Biomass: Technology, Economics, the Environment, and Policy," Annu. Rev. Energy Environ. 1996, 21:403-65.
MacKenzie et al., "Multiple Chromosomes in Bacteria: The Yin and Yang of trp Gene Localization in *Rhodobacter sphaeroides* 2.4.1," Genetics 153: 525-538 (Oct. 1999).
Manchenko, Gennady P., "Handbook of Detection of Enzymes on Electrophoretic Gels," CRC Press, Inc. 1994, pp. 220-240.
McCoy, Michael, "Chemical Makers Try Biotech Paths," Chemical Engineering News, Jun. 22, 1998, pp. 13-19.
Michel et al., "Specificity of the protein secretory apparatus: secretion of the heat-labile enterotoxin B subunit pentamers by different species of Gram bacteria," Gene 152 (1995) pp. 41-45.
Mosier et al., "Industrial Scale-Up of pH-Controlled Liquid Hot Water Pretreatment of Corn Fiber for Fuel Ethanol Production," Applied Biochemistry and Biotechnology, vol. 125, 2005, pp. 77-97.
Ng et al., 1981, Applied and Environmental Microbiology, 41(6):1337-1343.
Ohta et al., "Purification and Characterization of an Acidophilic Xylanase from *Aureobasidium pullulans* var. melanigenum and Sequence Analysis of the Encoding Gene," Journal of Bioscience and Bioengineering, vol. 92, No. 3, 262-270, 2001.
Ooshima et al., "Simultaneous saccharification and fermentation of cellulose: Effect of ethanol on enzymatic saccharification of cellulose," Department of Applied Chemistry, Faculty of Engineering, Osaka City University, Osaka 558, Japan, Jun. 5, 1984.
Pajunen et al., Microbiology (2005) 151, 1209-1218.
Patel et al., (2006), "Medium and long-term opportunities and risks of the biotechnological production of bulk chemicals from renewable resources: The potential of white biotechnology". The BREW Project. Final Report prepared under the European Commission's GROWTH Programme (DG Research), (publica.fraunhofer.de/eprints/N-48834.pdf).
PCT International Search Report and Written Opinion of the International Searching Authority for PCT/US10/51095, dated Dec. 2, 2010, 11 pages.
PCT International Search Report and Written Opinion of the International Search Authority for PCT/US11/34852, dated Oct. 21, 2011, 12 pages.
Perlack et al., "Biomass as Feedstock for a Bioenergy and Bioproducts Industry: The Technical Feasibility of a Billion-Ton Annual Supply," USDA and DOE, Apr. 2005, 78 pages.
Peyton et al., "Biotransformation of Toxic Organic and Inorganic Contaminants by Halophilic Bacteria," Halophilic Microorganisms, Antionio Ventosa (Ed.), Springer, 2004, pp. 315-331.
Ragauskas et al., "The Path Forward for Biofuels and Biomaterials," Science, Jan. 27, 2006, vol. 311, pp. 484-4589.
Ramos et al., "Biomechanical and Biochemical Pulping of Sugarcane Bagasse with *Ceriporiopsis subvermispora* Fungal and Xylanase Pretreatments," J. Agric. Food Chem. 2001, 49, 1180-1186.
Saeman et al., "Quantitative Saccharification of Wood and Cellulose," Industrial and Engineering Chemistry, Jan. 1945, vol. 17, No. 1, pp. 35-37.
Saha et al., "Dilute Acid Pretreatment, Enzymatic Saccharification, and Fermentation of Rice Hulls to Ethanol," Biotechnol. Prog. 2005, 21, 816-822.
Sa-Pereira et al., "Rapid production of thermostable cellulose-free xylanase by a strain of *Bacillus subtilis* and its properties," Enzyme and Microbial Technology, 30 (2002) 924-933.
Schell et al., "Dilute-Sulfuric Acid Pretreatment of Corn Stover in Pilot-Scale Reactor," Applied Biochemistry and Biotechnology, vol. 105-108, 2003, pp. 69-85.
Broun et al. "Catalytic Plasticity of Fatty Acid Modification Enzymes Underlying Chemical Diversity of Plant Lipids" Science vol. 282 Nov. 13, 1998 pp. 1315-1317 (4 pages).
Devos et al. "Practical Limits of Functiona Prediction" Proteins: Structure, Function, and Genetics 41 (2000) pp. 98-107 (10 pages).
Seffernick et al. "Melamine Deaminase and Atrazine Chlorohydrolase: 98 Percent Identical but Functionally Different" Journal of Bacteriology vol. 183, No. 8, Apr. 2001 pp. 2045-2410 (6 pages).
Whisstock et al. "Prediction of Protein Function from Protein Sequence and Structure" Quarlty Reviews of Biophysics 36, 3 (2003) pp. 307-340 (35 pages).
Witkowski et al. "Conversion of a β-Ketoacyl Synthase to a Malonyl Decarboxylase by Replacement of the Active-Site Cysteine with Glutamine" American Chemical Society, Biochemistry, vol. 38, No. 36, 1999 pp. 11643-11650 (8 pages).
Extended Supplementary European Search Report for EP 09 70 9191, dated Mar. 29, 2012, 6 pages.
PCT International Search Report and Written Opinion of the International Searching Authority for PCT/US09/35331, dated Feb. 23, 2010, 10 pages.
PCT International Search Report and Written Opinion of the International Searching Authority for PCT/US09/35275, dated Feb. 25, 2010, 13 pages.
GenBank: E17054.1 Direct Submission *Alicyclobacillus acidocaldarius* genomic DNA clone pOP3 containing acyl carrier protein gene. Nov. 5, 2005 [Retrieved from the Internet Jan. 23, 2010: http://www.ncbi.nlm.nih.gov/nuccore/E17054.1?ordinalpos=2 &tool=EntrezSystem2.PEntrez.Sequence.Sequence_ResultsPanel. Sequence_RVDocSum], 3 pages.

(56) References Cited

OTHER PUBLICATIONS

GenBank: E17054.1 Direct Submission *Alicyclobacillus acidocaldarius* genomic DNA clone pOP3 containing acyl carrier protein gene. Nov. 5, 2005 [Retrieved from the Internet Jan. 23, 2010: http://www.ncbi.nlm.nih.gov/nuccore/E17054.1?ordinalpos=2 &tool=EntrezSystem2.PEntrez.Sequence.Sequence_ResultsPanel. Sequence_RVDocSum], 1 page.

Hulsmann et al., "Maltose and maltodextrin transport in the thermoacidophilic gram-positive bacterium *Alicyclobacillus acidocaldarius* is mediated by a high-affinity transport system that includes a maltose binding protein tolerant to low pH," J. Bacteriol. 2000, 182(22):6292-6301.

Jones et al., "Cloning and transcriptional analysis of the *Thermoanaerobacter ethanolicus* strain 39E maltose ABC transport system," Extremophiles 2002, 6:291-299.

Schafer et al., "X-ray Structures of the Maltose-Maltodextrin-binding Protein of the Thermoacidophilic Bacterium *Alicyclobacillus acidocaldarius* Provide Insight into Acid Stability of Proteins," J. Mol. Biol. 2004, 335:261-274.

Scheffel et al., "Functional reconstitution of a maltrose ATP-binding cassette transporter from the thermoacidophilic gram-positive bacterium *Alicyclobacillus acidocaldarius*," Biochem Biophy Acta, 2004, 1656(1):57-65.

Schneider, "Import of solutes by ABC transporters—the maltose system. ABC protein: from bacteria to man," Elsevier Science, London 2003, p. 157-185. [Retrieved from the Internet on Jan. 24, 2010; <http://www2.hu-berlin.de/biologie/baktphys/paper/1_ABC/review_chap-09.pdf].

Uniprot Direct submission Q9RHZ5_ALIAC, "Putative maltose transport membrane protein malF," Nov. 13, 2007. [Retrieved from the Internet Jan. 22, 2010: <http://www.uniprot.org/uniprot/Q9RHZ5.txt?version=30?].

Lauro et al., "Isolation and characterization of a new family 42 beta-galactosidase from the thermoacidophilic bacterium *Alicyclobacillus acidocaldarius*: Identification of the active site residues," Biochimica et Biophysica Acta 1784 (2008) 292-301.

International Search Report of the International Searching Authority for PCT/US06/42566, dated Jul. 25, 2008.

PCT International Preliminary Report on Patentability of the International Search Authority for PCT/US09/32333, dated Aug. 3, 2010.

PCT International Preliminary Report on Patentability of the International Searching Authority for PCT/US09/00442, dated Jul. 27, 2010.

PCT International Preliminary Report on Patentability of the International Searching Authority for PCT/US09/34701, dated Aug. 24, 2010.

PCT International Preliminary Report on Patentability of the International Searching Authority for PCT/US09/35275, dated Aug. 31, 2010.

PCT International Preliminary Report on Patentability of the International Searching Authority for PCT/US09/35331, dated Aug. 31, 2010.

PCT International Preliminary Report on Patentability of the International Search Authority for PCT/US09/35307, mailed Jan. 25, 2011.

PCT International Search Report of the International Search Authority for PCT/US10/25521 Jul. 14, 2010.

International Preliminary Report on Patentability and Written Opinion of the International Searching Authority for PCT/US06/42566 dated Apr. 23, 2009 (7 pages).

International Search Report and Written Opinion of the International Search Authority for PCT/US09/32333, mailed Jun. 19, 2009, 9 pages.

Ito et al., "Purification and properties of acid stable xylanases from *Aspergillus kawachii*," Bioscience Biotechnology and Biochemistry 56 (4):547-550, Apr. 1992.

Jeffries, 1996, Curr. Op. in Biotech., 7:337-342.

Kievitis, T. et al., 1991, J. Virol. Methods, 35: 273-286.

Kohler, G. et al., 1975, Nature, 256(5517): 495497.

Kwoh, D. Y. et al., 1989, PNAS. USA, 86: 1173-1177.

Lavarack et al., "The acid hydrolysis of sugarcane begasse hemicellulose to produce xylose, arabinose, glucose and other products," Biomass and Bioenergy 23 (2002) 367-380.

Liu C, and CE Wyman, 2003, The effect of flow rate of compressed hot water on xylan, lignin, and total mass removal from corn stover, Ind. Eng. Chem. Res., 42:5409-5416.

Lucas et al., C4-Dicarboxylate Transporter/Malic Acid Transport Protein [*Alicyclobacillus acidocaldarius* LAA1], GenBank Direct Submission, Accession No. EED06059, Dec. 17, 2008 (Retrieved from the Internet Dec. 15, 2009: <URL:http://www.ncbl.nlm.nlh.gov/protein/218238848), p. 2.

Luckow, V. A., 1993, Baculovirus systems for the expression of human gene products. Curr. Op. Biotechnology 4: 564-572.

Lynd et al., 2002, Micro. and Mol. Biol. Rev., vol. 66, No. 3, p. 506-577.

Malherbe and Cloete, 2002, Re/View in Environmental Science and Bio/Technology, 1: 105-114.

Matthews, J. A. et al., 1988, Anal. Biochem., 169: 1-25.

Merrifield, R. D., 1966, J. Am. Chem. Soc., 88(21): 5051-5052.

Miele, E. A. et al., 1983, J. Mol. Biol., 171: 281-295.

Mielenz, 2001, Curr. Op. in Micro., 4:324-329.

Neddleman and Wunsch, J. Mol. Biol. 48: 443 (1970).

Olins, P. O., and Lee, S. C., 1993, Recent advances in heterologous gene expression in *E. coli*. Curr. Op. Biotechnology 4: 520-525.

PCT International Search Report and Written Opinion of the International Searching Authority for PCT/US09/00442, dated May 18, 2009, 8 pages.

PCT International Search Report and Written Opinion of the International Searching Authority for PCT/US09/34701, dated Jan. 12, 2010, 10 pages.

Pearson and Lipman, Proc. Natl. Acad. Sci. (U.S.A.) 85: 2444 (1988).

Sanchez-Pescador, R., 1988, J. Clin. Microbiol., 26(10): 1934-1938.

Schäffer, C. et al., 2001, Prokaryotic glycosylation. Proteomics, 1: 248-261.

Schwermann, B. et al., 1994, Purification, properties and structural aspects of a thermoacidophilic alpha-amylase from *Alicyclobacillus acidocaldarius* ATCC 27009, insight into acidostability of proteins. Eur. J. Biochem. 226: 981-991.

Shallom et al., "Microbial hemicellulases," Current Opinion in Microbiology, Current Biology Ltd, GB, vol. 6, No. 3, Jun. 1, 2003, pp. 219-228.

Supplemental European Search Report for EP 06 82 7231, dated Nov. 12, 2009, 6 pages.

Tsao, GT, MR Ladisch, and HR Bungay, 1987. Biomass Refining, In Advanced Biochemical Engineering, Wiley Interscience, N.Y., 79-101.

UniProtKB/TrEMBL Q9JRQ1 [online]. Oct. 1, 2000. Available on the internet at <<URL://http://www.uniprot.org/uniprot/Q9JRQ1>>.

Upreti et al., 2003, Bacterial glycoproteins: Functions, biosynthesis and applications. Proteomics, 3: 363-379.

Urdea, M. S., 1988, Nucleic Acids Research, II: 4937-4957.

Vieille and Zeikus, 2001, Micro. and Mol. Biol. Rev., vol. 65, No. 1, p. 1-43.

Walker, G. T. et al., 1992, NAR 20: 1691-1696.

Walker, G. T. et al., 1992, PNAS. USA, 89: 392-396.

Bhatia et al., "Microbial beta-Glucosidases: Cloning, Properties, and Applications," Critical Reviews in Biotechnology, 22(4):375-407, Jan. 1, 2002.

Breves et al., "Genes Encoding Two Different beta-Glucosidases of *Thermoanaerobacter brockii* are Clustered in a Common Operon," Applied and Environmental Microbiology, vol. 63, No. 10, Oct. 1997, pp. 3902-3910.

Database EMBL [Online]. Mar. 16, 2007. XP-002627757. Database accession No. ER073884, 1 page.

Database Geneseq [Online]. May 21, 1998. XP-002627734. Database accession No. AAW35004, 1 page.

Database UniProt [Online]. May 1, 1997. XP-002630045. Database accession No. P96090, 1 page.

Database UniProt [Online]. Oct. 1, 2001. XP-002627736. Database accession No. Q97UI4, 1 page.

Database UniProt [Online]. Jun. 26, 2007. XP-002627735. Database accession No. A5IKZ4, 1 page.

(56) References Cited

OTHER PUBLICATIONS

Database UniProt [Online]. Nov. 3, 2009. XP-002627733. Database accession No. C8WTP2, 1 page.
Extended Supplementary European Search Report for EP 09 70 3173, dated Apr. 20, 2011, 7 pages.
PCT International Search Report and Written Opinion of the International Search Authority for PCT/US09/35307, dated Jun. 10, 2010, 10 pages.
Extended Supplementary European Search Report for EP 10 74 6882, dated Aug. 27, 2012, 9 pages.
Database UniProt [Online]. Feb. 10, 2009. XP-002674095. Database accession No. B7DM51, 1 page.
Extended Supplementary European Search Report for EP 09 75 5307, dated Apr. 18, 2012, 4 pages.
GenBank: AJ252161.1 *Alicyclobacillus acidocaldarius* maltose/maltodextrine transport gene region(malEFGR genese, cdaA gene and glcA gene), NCBI, Hulsmann, A. http://www.ncbi.nlm.nih.gov/nuccore/AJ252161 (Jan. 6, 2000).
Database Score [Online]. Nov. 3, 2009. Database accession No. C8WYA8, 2 pages.
Database Score [Online]. Feb. 10, 2009. Database accession No. B7DQJ6, 2 pages.
Database UniProt [Online]. Feb. 10, 2009. XP-002698982. Database accession No. B7DRM6, 1 page.
Extended Supplementary European Search Report for EP 09 75 5308, dated Jun. 18, 2013, 3 pages.
Database UniProt [Online]. Feb. 10, 2009. XP-002695727. Database accession No. B7DUZ1, 1 page.
Extended Supplementary European Search Report for EP 09 74 3132, dated Apr. 19, 2013, 4 pages.
Database Uniprot [Online] Nov. 3, 2009. Database accession No. C8WVZ2, 2 pages.

FIG. 1

```
ref|YP_001223775.1|  --MKIAFFTETFLPKVDGIVTRLTKTVKHLVDAGDEVIVFCPEGCPEEYMGARLIGVPAM
ref|ZP_01471594.1|   --MKVAFFTETFLPKVDGIVTRLTKTVKHLVDAGDEVMVFCPEGCPDNYMGAKLVGVPAM
ref|YP_729290.1|     --MKIAFFTETFLPKVDGIVTRLTKTVKHLVDAGDEVVVFCPEGAPSHYMGAKVVGVPAM
ref|ZP_01079150.1|   --MKIAFFTETFLPKVDGIVTRLTKTVKHLVEAGDEVLVFCPEGAPSEYMGAGVIGVPAM
ref|ZP_01084440.1|   --MKIALFTETFLPKVDGIVTRLTKTVEHLVRAGDEVLLFCPEGAPSLYMGARVIGVPAL
RAAC00164            MSMRIAMFTETFLPSTDGIVTRLCATLKYLEREGHEVLLFAPSGSPETYASATIVGIPAM
                       *::*:*******..******  *::.*   *.**::*.*.*.*.  *  .*  ::*:**:

ref|YP_001223775.1|  PLPLYPELKLALPRPAVSEAIDSFQPDLIHVVNPAVLGLGGIWLAKAKSIPLVASYHTHL
ref|ZP_01471594.1|   PLPLYPELKLALPRPAVSDAIDAFQPDLIHVVNPAVLGLGGIWLAKTKGIPLVASYHTHL
ref|YP_729290.1|     PLPLYPELKLALPRPAVSEAIDAFQPDLIHVVNPAVLGLGGIWLAKTKSIPLIASYHTHL
ref|ZP_01079150.1|   PLPLYPELKLALPRPAVSEAIDAFQPDLVHVVNPAVLGLGGIWLAKNKAIPLIASYHTHL
ref|ZP_01084440.1|   PLPLYPELKLALPRPAVAEALEAFQPDVVHVVNPAVLGLGGIWMARTRQIPLVASYHTHL
RAAC00164            PFILYPEKRYSLPLPRIGKHLRAFRPDLIHVVNPAFLGIGGIYYAWKSHLPLVASYHTNV
                     *:.****  :.:**  *  :..  :  :*:**::******.**:***:  *      :**:*****::

ref|YP_001223775.1|  PKYLEHYGMGMLEPLLWELLKAAHNQALLNLCTSTAMVQELSDKGIQHTDLWQRGVDTEL
ref|ZP_01471594.1|   PKYLEHYGMGMLEPLLWEMLKAAHNQALLNLCTSTAMVKELSEKGIQHTDLWQRGVDTDL
ref|YP_729290.1|     PKYLEHYGMGMLEPLLWELLKAAHNQAVLNLCTSTAMVQELSDKGIQHTALWQRGVDTEL
ref|ZP_01079150.1|   PKYLEHYGMGMLEPLLWELLKAAHNQAELNLCTSTAMVKELSEKGIQHTALWQRGVDTEL
ref|ZP_01084440.1|   PKYLEHYGMGVLEPLLWELLKAAHNQAVLNLCTSSVMVEELAQRGIQHTALWQRGVDTEM
RAAC00164            PAYARHYKLEFLEPLLWWYFRTLHNRAHLNLATSRATLRELERQGFQNLELWERGVDVEL
                     * *  .**  :.******   :::  **:*  ***.**  .  :.**   :*:*:  **:****.::

ref|YP_001223775.1|  FRPDLRSAELRQRLLGRHDDRGALLLYVGRLSAEKQIERIKPVLEALPDARLALVGDGPH
ref|ZP_01471594.1|   FRPELRSETMRQRLLGRHDDRGSLLLYVGRLSAEKQIERIKPVLEALPDTRLALVGDGPH
ref|YP_729290.1|     FRPELRSPELRQRLLGEYDDRGALLLYVGRLSAEKQIERIRPVLEALPDTRLALVGDGPH
ref|ZP_01079150.1|   FRPELRSDAMRQRLLGAHDDRCALLLYVGRLSAEKQTERIRPVLEALPDTRLALVGDGPH
ref|ZP_01084440.1|   FRPELRSDAMRRRLMGRHPDSDSLLLYVGRLSAEKQIERIRPVLDALPQARLALVGDGPH
RAAC00164            FRNAPYSEEMRRRLAPEAKPGDRVLLYVGRLASEKNIERMRPVLDAIPDLHLAIVGDGPH
                     **   *  :*: :     :***:::*:::*:*:*:  ::**** ref|YP_001223775.1|  RQQLEKHFEGTATTFVGYLAGEELAGAYASGDAFLFPSSTETLGLVLLEAMAAGCPVVGA
ref|ZP_01471594.1|   RQQLEKHFEGTATTFVGYLAGEELASAYASGDAFLFPSSTETLGLVLLEAMAAGCPVVGA
ref|YP_729290.1|     RQQLEKHFEGTATTFVGYLAGEELAGAYASGDAFLFPSSTETLGLVLLEAMAAGCPVVGA
ref|ZP_01079150.1|   RQQLERHFEGTATTFVGYLAGEELASAYASGDAFLFPSSTETLGLVLLEAMAAGCPVVGA
ref|ZP_01084440.1|   RAQLEKVFEGTATTFVGYLGGEELAGAFASADAFLFPSSTETLGLVLLEAMAAGCPVVGA
RAAC00164            RPELERVFAGTRTHFTGYLHGEELAQAYRAADAFLFPSTTETLGLVLFEAMAAGLPIVAA
                     *  :**:  *  ** *  *.*  ***  *:  :.*****:******  *:*.* ref|YP_001223775.1|  NRGGIPDIISDGVNGCLYEPDGADGGAASLIAATQRLLGNDVERQALRNAARSEAERWGW
ref|ZP_01471594.1|   NRGGIPDIISDGINGCLYEPDGADEGAASLINAARKLLGNDIERQGLRTAARSEAERWGW
ref|YP_729290.1|     NRGGIPDIISDGVNGCLYEPDGADAGAGSLIEATGKLLGNDLERQALRNAARSEAERWGW
ref|ZP_01079150.1|   NRGGIPDIISDGLNGCLYEPDGADGGAASLIQATQRLLGNDLERQALRRAARTEAERWGW
ref|ZP_01084440.1|   NRGGIPDIVTDGVNGCLYDPD----DDASLTAATLRLLASPERREQLRLAARHEAERWGW
RAAC00164            DSPPTREVLEDGRAGFIFDPD----STESLIATVDLVMRDEARREAVRQRGLAIAEQLDW
                     :     :::  **   *  :::           :    :  .*:  :*    **: .* ref|YP_001223775.1|  AGATEQLRGYYRQVLKQPQLNAAA-----
ref|ZP_01471594.1|   AGATEQLRGYYRQVLQ-------------
ref|YP_729290.1|     AGATEQLRGYYRQVLSS------------
ref|ZP_01079150.1|   AGATEQLRTYYRNVLK-------------
ref|ZP_01084440.1|   AGATAQLRRFYRDV---------------
RAAC00164            EGPSKQLLGHYERVLQSFSVVAGAVTGTR
                     *.:  **    .*.  *
```

FIG. 2

```
ref|ZP_00589533.1|  ------------------------------------------------------------
ref|ZP_01386435.1|  ------------------------------------------------------------
ref|YP_374173.1|    ------------------------------------------------------------
ref|ZP_00513158.1|  ------------------------------------------------------------
ref|YP_378533.1|    ------------------------------------------------------------
RAAC00517           MCGGDTEFETFGGRRCEHMHGPVLFYDGLICLIALLNRLLWPRLNRDRENVGPKAETFTS ref|ZP_00589533.1|  --------VSVLVPARNEALNIERCVRSLMRQEYAPFEILVLDDDSTDATPELLRRLVVE
ref|ZP_01386435.1|  --------VSVLVPARNEALNIERCVRSLLMQDYAAFEILVLDDGSTDATPQLLQTLLDE
ref|YP_374173.1|    --------VSVLVPARNEERSIARCVQSLLMQDYPDFEVIVLDDASTDATLSILQALEAE
ref|ZP_00513158.1|  --------VSVLVPVRNEEHVIEACVLSLLAQDYPRYEVVVLDDCSEDRSLEILRRLEAA
ref|YP_378533.1|    --------VSILVPARNEAHNIERCINSLLQQRYESFEVLVLDDGSTDATPTLLAELAQH
RAAC00517           GRWKNLAPVALLIPARNEAHQIRRCLEAIGTSTDSSLEIIALDDESTDDTWSVLKETKAE
                            *::*:*.***    *  *: ::  .    *::.*** * *  :  :* ref|ZP_00589533.1|  SGGKVRIVQGEALPDGWHGKSWACSQLG-HQAKGELLLFTDADTTHKPDALRRTVGAMQA
ref|ZP_01386435.1|  SGGRLRVLQGEPLPDGWHGKAWACLQLSRQA-KGDLLLFTDADTKHEPDALRRSVAALNS
ref|YP_374173.1|    SCGRLRVLRGAVLPEGWHGKSWACRQLAEKA-SGEMLLFTDADTFHRPQALRRAVTALQE
ref|ZP_00513158.1|  SGSRLRIVQGKPLPEGWHGKAWACRQLGD-LGGGELLLFTDADTRHKPEGISRSVAALYE
ref|YP_378533.1|    AGGVLQVLQGGDPLPQGWHGKAWACQQLGE-AAHGDLLLFTDADTVHHPTALARSVAALQA
RAAC00517           ANQNLTLLRGTPRPQGWRGKNWACAQLADHAGDAEILIFIDADTRLEAGAVENIRSTMLA
                    :    :  :::*   *:**:**  ***  **.    .::*:* ****    ..  :  ::

ref|ZP_00589533.1|  SGADMLSLMPHQELGSFWEKLVVPLVHVI---LMCYLPLRFVRTSRRAAFCFANGQFILF
ref|ZP_01386435.1|  EKGDMLSLTPRQELGSLWEELVVPLVYVI---LLCYLPLRLVRTSRNPAFCFANGQFILF
ref|YP_374173.1|    GRGDMLSITPRQELGSFFEHLVVPLVYVI---LMSYLPLRLVRTLRNPAFCFANGQFILF
ref|ZP_00513158.1|  SGADMLTLTPYQEMAGFLEKLVIPLVYFI---LMCYLPLRFVRTSPKSVFCSAIGQFMLF
ref|YP_378533.1|    SQASMLSMTPLQTMHSWWEKIVVPLVYVV---LMNFLPLRFVRTTSIPAFSFANGQFILI
RAAC00517           RDIQLLSVLPRQEAHGLAALLVYLLPWSL----MAHVPLFLGRWRR-KALPIAIGQVLAF
                    .:*::  * *   .   :*  * :     : .:** : *   .: *  **.: :

ref|ZP_00589533.1|  RRECYTRINGHAAVREAIVEDVWLCKSVKKAGGTVVAFNGSDIVSCRMYHNFREIWEGFS
ref|ZP_01386435.1|  RREFYDRINGHTAVRQALAEDIGLCREVKRAGGRVVAFNGFDAVSCRMYRSFRDIWEGFS
ref|YP_374173.1|    RREFYWKVNGHEAVRDALVEDVWLCMAVKKAGGRVLSFNGTDALSCRMYRNFREVWEGFS
ref|ZP_00513158.1|  RREIYRNIGGHRAVKAAIVEDVWLCREVKKAGGRVAVYNGIDALSCRMYRSPGEIIRGFS
ref|YP_378533.1|    ERTMYRQLNGHAAVRQQLVEDVWLCMAVKKAGGRVVAINGVDLVSCRMYRSGKEVWEGFS
RAAC00517           QRSAYQTLGGHAAVRSAIAEDLALARKAARMGMIGAFLDGADIASCTMYTSWVRAWRGFQ
                    .*  *  :.** **: :.**: *.  . :  *     :*  **  ** .    .**.

ref|ZP_00589533.1|  KNLFAALGY-STPGLFVLILMISALYLVP-CLFFSYALIAGEFTVSLFWLPLMQM-MVAL
ref|ZP_01386435.1|  KNLYASLGY-STPGLFLLMTLTAAFYIAP-YLFFFYALIAGKFTMLLFWLPLTQM-VIAL
ref|YP_374173.1|    KNVFAGLGS-SIPGLAAFVLFTAAFHLAP-WGFLLYALFVGASGPALVLLPLLQL-AVAL
ref|ZP_00513158.1|  KNLFAGLGY-RSFGLFSLVVLTLAFHVLP-YGFLTAALLSGDFSA---------------
ref|YP_378533.1|    KNIFAGLGY-YHSALFGLLALIALFYIIP-IALLTTSVVQANYSATHFWLPLVQV-VLAF
RAAC00517           KNWCYTVGH-PLLSCLIWAWLTYAFTWLPMYGLAEACLGHLDLAALSQWPALLWIGVCSK
                    **    :*    .     :   :  *   .:

ref|ZP_00589533.1|  LCRIFIARI---------------------------
ref|ZP_01386435.1|  LSRVIIARLFGQSTAMVFL-NLFSQLILIAIAW------
ref|YP_374173.1|    SGRVLVARRFDQPTALTLL-DPLARGLLLAIALNS----
ref|ZP_00513158.1|  ----------------------------------
ref|YP_378533.1|    ANRWLVAFTFHQSRFMVFF-HPLTMVAFFAIACNSW---
RAAC00517           RYLQMPIWVFVTAPISVALGFVLACDSWIHNARNTTIWS
```

FIG. 3

```
ref|YP_001647987.1|  ----------AGAEDGGGKTHIISLLDQFPDGEVE-------LAVFEDGIVAKEARELG
ref|NP_835081.1|     ----------AGAEDGGGKTHIISLLDQFPTGEVE-------LAVFEDGIVAKEARELG
ref|YP_001377114.1|  ----------AGAEDGGGKTHIISLLDQFPTDEVE-------LAVFEDGIVAREAREIG
ref|YP_001127183.1|  ------VLHVISGGETGGSRKHVVTLLSKFAPGTAT-------LVVFQDGPLAAEARQAG
ref|ZP_02038504.1|   ------VIHLISGGDSGGAKTHVHMLLQNLSRTPGVEVT----MVCFMEGPFSQEARELG
RAAC00650            MASERTVIVFFAGNEVGGAATHLATWAKALKGAQVDYRYR---FVSLGDGPLADELRQMG
                           :*  :  **. .*:      . :        :. : :*  .: * *: * ref|YP_001647987.1|  IKVHVFSQKSRYDLSILKNISEFINKEKFDVVHTHGPRANFFVSLMKKKFAAKWVTTIHS
ref|NP_835081.1|     IKVHVFSQKSRYDLSILKNISEFINKEKFDVVHTHGPRANFYVSLMKKRIKAKWVTTIHS
ref|YP_001377114.1|  IKVHVFSQKSRYDLSILKNISRFINEEQFDIVHTHGPRANFYVSLMKKRIAAKWVTTIHS
ref|YP_001127183.1|  IDVRLLAQSSRYDLSVLSKLVALIRRERFDILHTHGPRANLYGALIKRKIAIPWMTTVHS
ref|ZP_02038504.1|   ISTVVLPGKN--IFRTFHTLKNMIREGGYEIIHCHGARGNMMGALLRKATGLPVVTTVHS
RAAC00650            MLHGAVAGTVG----AIRDLARVLRRERAWILHSHGPRMNMLASFAASSAGAIWTATIHS
                     :        ..  .      :  :  .:..    ::* **.* *:  ::         :*:**

ref|YP_001647987.1|  DPFQDFTKQGLKGWIFTKLNLKALKNIDLFFVVTNRLKKSLAALGISNEKMHVIYNGIEY
ref|NP_835081.1|     DPFQDFTKQGLKGWIFTKLNLKALKNIDLFFVVTNRLKKSLAALGISNEKMHVIYNGIEY
ref|YP_001377114.1|  DPFQDFTKQGLKGWIFTKLNLKALKDIDLFFVVTNRLKKSLEQLGISSEKMRVIYNGIEY
ref|YP_001127183.1|  DPRLDFMKSGWKGKWFTRLNVWALQKVDYFFAVSERFKESLMELGIAAERIQTIYNGIDF
ref|ZP_02038504.1|   DYRLDYMGRPISRITYGTINTLALRLLDYRIGVSDAMTDLLISRGFDPDKLFTIYNGIDF
RAAC00650            HPRYDFEGHPLKAALFPSLHLWRLSRARGLFVVQPALGDALPCR-TILEVPNAFFPRLPR
                     . *:   .       :  . ::    *         : *   : . *        :  . .::  :

ref|YP_001647987.1|  DQEKADGYN--------KKEMFNIDEDVFTAIQVARLHPVKGHEVLFDALQQTKL--EKI
ref|NP_835081.1|     DKEKAEGYN--------KKEMFNIDEDVFTAIQVARLHPVKGHEVLFDALQQTKL--EKI
ref|YP_001377114.1|  DKEKAQGYD--------KKEKFHIEEDVFTAIQVARLHPVKGHEVLFDALNNTSL--TKI
ref|YP_001127183.1|  DDAPRPHM--------LQRADLGLREDDLVIAMVARLHPIKGHALVFEALASLSD--PDM
ref|ZP_02038504.1|   TPRTPSMTR----SEYLKSVGANWPEDCVVAGIAARLNPVKDIPTLIRGFAQARQSCPKL
RAAC00650            ASRDVCAAE-------WRRRLGLNPESRLIGIAARLDPVKQIDVAIAALALLSD--LDV
                                              :    .***.*;*         :  .:        .:

ref|YP_001647987.1|  KVLLVGDGPLERELKALATEKGINDKVEFLGHRQDVKQLFASSHVNLLTSHSEGFPPLVLL
ref|NP_835081.1|     KVLLVGDGPLEENLKSLATEKGINDKVEFLGHRQDVKQLFASSHVNLLTSHSEGFPPLVLL
ref|YP_001377114.1|  KVLLVGDGPLEEDLKALAKEKGIDDKVQFLGHRQDVKQLFASAHINLLTSHSEGFPPLVLL
ref|YP_001127183.1|  KLLVVGDGPLASELREKATQSGIGRQVQFLGFRRDVADIYALSDVALMASYSESFPPLALL
ref|ZP_02038504.1|   RLLIAGDGEQMNELKALAADLGVAEDVCFAGWVSDVDSFYGALDINTLTSLSETFPYSLT
RAAC00650            HLLVAGDGRDRIRLEAAAEDCGVRHRVHFLGHLQDVRDLYCAIDVHVLPSKSEGAPTSML
                     ::*:.***    *. * *:  *  *  ** .::   .: :.* **  * :

ref|YP_001647987.1|  EAANQRVPSIVTRAGEIEPLIADETYGWIVPTGDGKALASAL------------------
ref|NP_835081.1|     EAANQRVPSIVTRAGEIEPLIVDETYGWIVPTGDGKALALAL------------------
ref|YP_001377114.1|  EAANQRVPSIVTRAGEIEPLIVDDTYGWVVPVGDGKALANALEQ---------------
ref|YP_001127183.1|  EAANERLPVISTDVGGVSQLIASSDMGWIVPVGDRAALAQAMREARSRRHELKTMGKRLY
ref|ZP_02038504.1|   EGARAGLPTVASRVGGVPYLIDHGVNGLLFEAGDYETLAKHLTALASDETMRTHMGQRLY
RAAC00650            EAGYYGAANIGSDVPGIRRMLLDGEAGALVPSGDVQALAHAVRRLLTDTKARDAYVERFQ
                     *..     .  :   :   :          *  :.  **  :**   :

ref|YP_001647987.1|  --------------------------------------------
ref|NP_835081.1|     --------------------------------------------
ref|YP_001377114.1|  --------------------------------------------
ref|YP_001127183.1|  EHASTHFSLQRLYEETM-ATYER--------------------
ref|ZP_02038504.1|   QKGKNDYSLESTLQRQLEIYSVI--------------------
RAAC00650            RLVLPRYRPERMVVAYERGYTVIEEDAVRSGWRLPANSEQTR
```

FIG. 4

```
ref|NP_831314.1|          ---------------------LKIGITCYPSVGGSGVVGTELGKQLAERGHEIHFITSG
ref|NP_844008.1|          ---------------------LKIGITCYPSVGGSGVVGTELGKQLAERGHEIHFITSG
ref|ZP_01172765.1|        ---------------------LKIGITCYPTVGGSGVVATELGKLLAERGHEIHFISSS
ref|YP_001487207.1|       ---------------------LKVGITCYPSVGGSGIIATELGKRLAEKGHDVHFITSS
ref|ZP_02327412.1|        ---------------------LKIGITCYPSLGGSGVVATELGKLLAEQGHEVHFIAHS
RAAC00991                 ---------------------MRVGISCYPTVGGSGAVATELGKALARRGHEVHFIVTD
                                               : ::***:*** ****  : :***** **.:**:.***   .

ref|NP_831314.1|          LPFRLNKVYPNIYFHEVTVNQYSVFQYPPYDLALASKMAEVAQRENLDILHVHYAIPHAI
ref|NP_844008.1|          LPFRLNKVYPNIYFHEVTVNQYSVFQYPPYDLALASKMAEVAQRENLDILHVHYAIPHAI
ref|ZP_01172765.1|        LPFRLNRMYHNIFYHQVEVSQYVFQYPPYDIALASKMAEVINREKLDLMHVHYAVPHAV
ref|YP_001487207.1|       IPFRLNKVYPNIYFHEVDVNQYAVFQYPPYDLALASKLAEVARREKLDIIHAHYAVPHAV
ref|ZP_02327412.1|        MPFRLGRFDKNVFYHEVEVSDYYVFKYPPYDLSLASKLAQVARMQELDLLHVHYAIPHAV
RAAC00991                 VPFRLGAFVEHVYIHQIEPITYPVLKTPPYDFALASLMARVADEYQLDVLHAHYALPFAV
                           :****.    ::: *::      * *:: ****::***  :*.*      :**:*.***:*.*:

ref|NP_831314.1|          CAYLAKQMIGERIKIVTTLHGTDITVLGSDPSLNNLIRFGIEQSDVVTAVSHSLINETHE
ref|NP_844008.1|          CAYLAKQMIGERIKIVTTLHGTDITVLGSDPSLNNLIRFGIEQSDVVTAVSHSLINETHE
ref|ZP_01172765.1|        CAILAKQMSGRDVKIATTLHGTDITVLGYEPSLKDSIRFGIEKSDRVTAVSKSLISQTNE
ref|YP_001487207.1|       CAYLAKQMTGHSVKVVTTLHGTDITVLGYDPSLKEVIRFAIESSDRVTAVSHSLAAQTYD
ref|ZP_02327412.1|        CALLAKQMVGDHLKVVTTLHGTDITVLAQDASISNMIRFAINESDAVTAVSEDLIRETRQ
RAAC00991                 CAHLAREMAKHPIRVVTTLHGTDITVLAQDPSLKSIIKLGIERSDAVTAVSQSLVRDTAR
                           ::*      :::.***********. :.*:.. *::.*:  ***..*   :* ref|NP_831314.1|          LVKPSKEIQTVYNFIDERVYFKRNMSQLKKEYGISESEKVLIHISNFRKVKRVQDVVQAF
ref|NP_844008.1|          LVKPNKDIQTVYNFIDERVYFKRDMTQLKKEYGISESEKILIHISNFRKVKRVQDVVQAF
ref|ZP_01172765.1|        LIHPEKEIQAVYNFIDHRVYQKTGSDHLKKEYGITEDEKTVIHVSNFRAVKRVQDVVKVF
ref|YP_001487207.1|       LIKPNKKIETIHNFVDERVYLRDDHNVLKRHYGLLDHEKVVIHVSNFRKVKRVHDVIHVF
ref|ZP_02327412.1|        TLDIQKPIHKIYNFVDKRMYYPRPVEDLKREVTRP-GEKLFIHISNFRPVKRVHDVVQIF
RAAC00991                 LFETDKPIRCIYNFVDPDVFRPGCGGELKRHFAPN-GERVLLHISNFRPVKRLHDVIAVF
                          ..  .* *.  ::**:*   ::        **:.       *:  ..:*:**  *:;**:    * ref|NP_831314.1|          AKIVKEVDAKLLLVGDGPEFCTILQIVKNLHIEDRVLFLGKQDNVAELLAMSDLMLLLSE
ref|NP_844008.1|          AKIVTEVDAKLLLVGDGPEFCTILQLVKNLHIEDRVLFLGKQDNVAELLAMSDLMLLLSE
ref|ZP_01172765.1|        ARIESEMPAKLLLVGDGPEMSNVCKLVKELGLKEKVLFLGKQDKVEELYSISDLMLLLSE
ref|YP_001487207.1|       KKISEQVNAKLLLIGDGPEKSVVCELVKKLGLTDRVLFLGKQEKVEELYSISDLKLLLSE
ref|ZP_02327412.1|        ARVHREIPSRLLLVGEGLELSRIVSEVRELGLQDFVEFWGKQDDVAQVISLADVMLLPSE
RAAC00991                 ERVARRMPAKLLLVGEGPDLGAAKRQVEEAGLGDRVHFLGRQDEVAPLFAAADLFLLPSE
                           ::    .:  ::***:*:* :     *.:    : : * *:*::.*    :  : :*: ** **

ref|NP_831314.1|          KESFGLVLLEAMACGVPCIGTRVGGIPEVIQHGETGYLCEVGDTTGVANQAIQLLKDEEL
ref|NP_844008.1|          KESFGLVLLEAMACGVPCIGTRVGGIPEVIQHGDTGYLCEVGDTTGVADQAIQLLKDEEL
ref|ZP_01172765.1         KESFGLVALEAMACGVPCIGTNIGGIPEVISDGETGYICKLGDIGSMAEKAAGLLADADK
ref|YP_001487207.1|       KESFGLVLLEAMACGVPCIGTDVGGIPEVITHGETGFLVPLGDIDAAAKHAVSILKDKAL
ref|ZP_02327412.1|        KESFGLVALEAMACGVPTVGSNAGGIPELITHGETGFMAEVGDVDTMSKYTIRLLEDEEL
RAAC00991                 SESFGLVALEAMSCGVPVVGSTAGGIPEVVVHGETGFLAPVGRVDDMADLACKLLQDEAT
                          .**** :**   :*:   ***:: .:*:: :*      :. :  :* * ref|NP_831314.1|          HRNMGERARESVYEQFRSEKIVSQYETIYYDVLRDDK----------
ref|NP_844008.1|          HRNMGERARESVYEQFRSEKIVSQYETIYYDVLRDDK----------
ref|ZP_01172765.1|        HTSFSHRAVQTAREKFSAEQIVSEYERLYFDML--------------
ref|YP_001487207.1|       HEQVSAAAQSSVQAHFSSEKIVSEYEELYLELIEGD-----------
ref|ZP_02327412.1|        LKRVSEACVQRARKKFCNDSLRARYEQVYYEVL--------------
RAAC00991                 YRAFSARAREREAVRAFHVDEKVSEYEALYREVMAAERGEHAHPRPGA
                            ..    . ..   *  :.   :.** :*  :::
```

FIG. 5A

```
ref|ZP_01331931.1|      ---------------LVLLFGRGGFWRARAARRLPPDARGAAAAAGWPAVAAVVPAR---
ref|YP_336440.1|        ---------------LVLLFGRGGFWRARAARRLPPDARGAAAAAGWPAVAAVVPAR---
ref|YP_001076955.1|     ---------------LVLLFGRGGFWRARAARRLPPDARGAAAAAGWPAVATVVPAR---
ref|YP_001519856.1|     ------------------------------------------------------------
RAAC01110               MTALAWAAAVSLAAWIFLLFGRGFYWRTALSMNTARMAAEARAPRAWPAVWAVVPAR---
ref|YP_711688.1|        ---------------LYLAVGHGFFWRTDQRLPAR------QAPPSWPSVAIIIPAR--- ref|ZP_01331931.1|      ---NEADVIGEAVRSLVEQAYEGAFHLIVVDDHSTDGTAEAARAAAAAVGCADR----LT
ref|YP_336440.1|        ---NEADVIGEAVRSLVEQAYEGAFHLIVVDDHSTDGTAEAARAAAAAVGCADR----LT
ref|YP_001076955.1|     ---NEADVIGEAVRSLVEQAYEGAFHLIVVDDHSTDGTAEAARAAAAAVGCADR----LT
ref|YP_001519856.1|     ---NEAEVLPVSLRSLLQQTYPGPFKILLIDDQSTDQTREIAQQIATDLDRNHQ----LQ
RAAC01110               ---NEADVLPRTLPTLLSQAYPGEFHVVLVDDHSTDGTAEVAERLASELRLAHR----LR
ref|YP_711688.1|        ---DEADVLPVTLPTLLAQDYPGPVRLILVDDGSTDGTTEVARALAEQAARNGHTGVTAA
                           :**:*:    ::  :*:   *   * * *  .:::::**.***.*  *.   *        :

ref|ZP_01331931.1|      VLAAQPLPAGWSGKVWAQSQGIAAVRSLGLPADYLLLTDADIGHPPDAVAQLVTRAQAEQ
ref|YP_336440.1|        VLAAQPLPAGWSGKVWAQSQGIAAVRSLGLPADYLLLTDADIGHPPDAVAQLVTRAQAEQ
ref|YP_001076955.1|     VLAAQPLPAGWSGKVWAQSQGIAAVRSLGLPADYLLLTDADIGHPPDAVAQLVTRAQAEQ
ref|YP_001519856.1|     VIQTAPLPPGWSGKLWAMHQGIEMVLAESTQPTYFLLTDADIQHEANSLLSLVTKAEQED
RAAC01110               VVRADALPPGWAGKVWAMQNGLRHVPDD---AAYVLFTDADISHSPTSVQALVARAERDG
ref|YP_711688.1|        VTASTEPPPGWTGKLWALRRGV-DCAGD---AEFLLLTDADIAHDPGSLTSLVASARTHG
                        *  :    *.**:**:**  .*:      . :.*:*****  *  .  ::    **: *. .

ref|ZP_01331931.1|      RDLVSLMVRLRCDSFWEKALIPAFVFFFAKLYPFSWINDPRNRTAGAAGGCMLVRRDALE
ref|YP_336440.1|        RDLVSLMVRLRCDSFWEKALIPAFVFFFAKLYPFSWINDPRNRTAGAAGGCMLVRRDALE
ref|YP_001076955.1|     RDLVSLMVRLRCDSFWEKALIPAFVFFFAKLYPFSWINDPRNRTAGAAGGCMLVRRDALE
ref|YP_001519856.1|     QDMVSLMVRLRCQSIWEQLLIPAFVFFFQKLYPFLWVNQPQKQMAAAAGGCILVRRQTLS
RAAC01110               LDLVSLMVRLRAESAWEKLLIPAFVYFAKLYPFAWVAHPRRRTAAAAGGCVLVRRRLLP
ref|YP_711688.1|        LDMVSQMAVLRAETVWERVIVPAFVYFFAMLYPFRWSNRPRSRVAAAAGGCSLVRREALL
                         *:** *. .:: :  ::**:   **** *   *: : *.*** **  * ref|ZP_01331931.1|      EAGGIESIRGALIDDCSLAAQIKHRGAGR--HPIRLDLADRSVSLRPYDSWRDIWNMIAR
ref|YP_336440.1|        EAGGIESIRGALIDDCSLAAQIKHRGAGR--HPIRLDLADRSVSLRPYDSWRDIWNMIAR
ref|YP_001076955.1|     EAGGIESIRGALIDDCSLAAQIKHRGAGR--HPIRLDLADRSVSLRPYDSWRDIWNMIAR
ref|YP_001519856.1|     TIGGIQVIRDALIDDCALAAAIKQTPNAQPNRNIWLGLTSATQSLRSYDTLDSIWSMVAR
RAAC01110               TPPGLEAIRDAVIDDCALARLVAD-GGGR----LWLGLGDDVVSVRAYGTLGEIWRMIAR
ref|YP_711688.1|        AAGGLAEVRGAVIDDVAIARIIKRSGGRT-----WLGLAEQVHSRRPYPRLADLWKMVSR
                           *:  :*.*:*** ::*   :         *.*  . * *.*       .:* *::* ref|ZP_01331931.1|      TAFTQLRYSPV----------LLLGTLVGMTILYLVPPVAALA----------YGARA
ref|YP_336440.1|        TAFTQLRYSPV----------LLLGTLVGMTILYLVPPVAALA----------YGARA
ref|YP_001076955.1|     TAFTQLRYSPV----------LLLGTLVGMTILYLVPPVAALA----------YGARA
ref|YP_001519856.1|     TAFTQLNYSTL----------LLIGTVVGMFLIYMVPPISIMLGLY------LESISIT
RAAC01110               TAFVQLRFSTV----------LLLGTALGMLLLYAVPPAAAIAGLVGLLAGAPGSLAAL
ref|YP_711688.1|        SAYAQLRHSPL----------LLLGTVLGMSLVFVVPVVATIAGLAAG------DGTTA
                        :*:.**..*.:          **:** :**  :::  **    :               :

ref|ZP_01331931.1|      WPAWLAWASMCT------AYAPMLSYYRRSPWWAPALPLVALFYVGATFASAVRYWRGKG
ref|YP_336440.1|        WPAWLAWASMCT------AYAPMLSYYRRSPWWAPALPLVALFYVGATFASAVRYWRGKG
ref|YP_001076955.1|     WPAWLAWASMCT------AYAPMLSYYRRSPWWAPALPLVALFYVGATFASAVRYWRGKG
ref|YP_001519856.1|     VTGLITWVLMTL------AYLPTIRLYQLSPIWAVSLPLIALLYNLMTLDSARQHWQGKG
RAAC01110               CLGGLAYAILAS------TFVPMLRWYRLSPARSALLLPLAGVLYTLMTLDSARRFWLRTG
ref|YP_711688.1|        ILGAVAWVIMTL------SYVPMIRYYRQPVPAALLLPGVAVLYLGMTLDSARLKWAGRG
                         . :::. :       :: * :  *:  .   : **  .::*  *: ** * *
```

FIG. 5B

```
ref|ZP_01331931.1|     GQWKAR-------
ref|YP_336440.1|       GQWKAR-------
ref|YP_001076955.1|    GQWKAR-------
ref|YP_001519856.1|    GAWKGRVYPAR--
RAAC01110              DHWKGRPYEMRRP
ref|YP_711688.1|       AAWKGRTYD----
                         **.*
```

FIG. 6A

```
gb|AAR99615.1|         --------------------------------------------------VIRGRERFLTK
gb|ABM68334.2|         ----------------------------------------------------RGRERFLTK
RAAC01166              MDPNGRFASWGRTPIDVRVVSKHVEIGFPRLPMMRYTFLGSSRRIAGGPMFRTYQELFRR
ref|ZP_01372248.1|     --------------------------------------------------MIRENQKTLNM
ref|YP_519555.1|       --------------------------------------------------MIRENQKTLNM
ref|ZP_02234077.1|     ------------------------------------------------------QKLFNR
                                                                             :. :

gb|AAR99615.1|         LYAFVDFAMMQGAFFLAWVLKFKVFHNG-VGGHLPLEDYLFWSFVYGAIAIVIGYLVELY
gb|ABM68334.2|         LYAFVDFAMMQGAFFLAWVLKFKVFHDG-VGGHLPLEDYWFWSFVYGAIAIVIGYLVELY
RAAC01166              IFIATDAAIVVVSFLLAWWLKFDSGWIP-HAGHLPLLYYRGPLLIAVIVFVLANGVARLY
ref|ZP_01372248.1|     IQVILDLAIVVIALALAYWLRFANY----EGSHLKFESYVPTLVLLVPLHFFLYYLLGLY
ref|YP_519555.1|       IQVILDLGIVVIALALAYWYRFSNY----EGSYLKFESYVPTLVLLVPLHFFLYYLLGLY
ref|ZP_02234077.1|     LHVLIDALIIIFSYGAAWFIRFKSGLFALSSWYLSLSQYMKVLVFVVPIYLILYYAFQLY
                       :     *   ::  :  *:  :*       . :*  :  *  ..      : ..    **

gb|AAR99615.1|         APKRKEKFSNELAKVLQVHTLSMFVLLSVLFTFKTVDVSRSFLLLYFAWNLILVSIYRYI
gb|ABM68334.2|         APKRKEKFSNELAKVLQVHTLSMFILLSVLFTFKTVDVSRSFLLLYFAWNLTLASIYRYV
RAAC01166              EPMRAKSLFYEAYSVAKGVILGTIVLMAALYFAKMQEFSRDVIALFTGINFGLMVGERIV
ref|ZP_01372248.1|     EARRRKSLSFEVGKIIQANFLSTMILFTLLYIIKEIHYSRQVLIYFVIFTGTLTIAERMA
ref|YP_519555.1|       EARRRKSFSFEVGKIIQANLLSTMILFTLLYIIKEIDYSRQVLIYFIILTGTLTIAERVA
ref|ZP_02234077.1|     TPKRGQGRRIEAWHIVQANIIGLLVFILILYLAKMTDYSRKMLFVFFCVNVVAEIGFRNV
                        . *   :    *    :  :  .  ::::  *:  *  . **..:  :   .    * gb|AAR99615.1|         VKQSLRTLRKKGYNKQFVLIIGAGSIGRKYFENLQMHPEFGLEVVGFLDDFRTKHAPEFA
gb|ABM68334.2|         VKQSLRKLRKKWYNKQFVLIIGAGSIGRKYFENLQMHPEFGLEVVGFLDDFRTKHAPEFA
RAAC01166              VRSVLRSLRRRGLNQRFLLIVGWSAATRRFLEALEAQPWFGYRVIGYL---RYEGDDASR
ref|ZP_01372248.1|     LRAILNNIREKGYNKKHVLIIGTGRLAKRLVNALQENRYLGYEILGIVGENTAVGKKLAG
ref|YP_519555.1|       LRAILNNIREKGYNKKHVLIIGTGRLAKRLVNALQENRYLGYEILGIVGENTAVGKKLAG
ref|ZP_02234077.1|     LRWILRKYRKQGYNQKHILLVGYSRAAEGYLDRVVTHPEWGYIVKGILADNKPEGEEYRG
                       ::  *.. *.:  *::..*::*      .  .:  :    *  :  *   :

gb|AAR99615.1|         HYKPIIGQTADLEHVLSHQLIDEVIVALPLQAYPKYREIIAVCEKMGVRVSIIPDFYDIL
gb|ABM68334.2|         HYKPIIGQTADLEHVLSHQLIDEVIVALPLQAYPKYREIIAVCEKMGVRVSIIPDFYDML
RAAC01166              ATVPCIGAVDDIRCVLEEHLVDQVVIAAPRDRVGDLAEVISACEAVGVQSLILPDYFDLL
ref|ZP_01372248.1|     VTV--AGAISDLENIIMESKIDEIFITISTKDYDLFRNIIKICEKSGVRTQIVPDYARFI
ref|YP_519555.1|       VTV--AGAISDLENIIMESKIDEIFITISTKEYDLFRNIIKICEKSGVRTQIVPDYARFI
ref|ZP_02234077.1|     IKI--LGGTDKLAEILPQNQLDEIVITLGLAEYHKLGRIVNMCEKSGVHTKFVPDYNNII
                          *     .:  ::  . :*::.::      .::  ** **:  ::**:   ::

gb|AAR99615.1|         PAAPHFEIFGDLPIINVRDVPLDELRNRVLKRSFDIVFSLVAIIVTSPIMLLIAIGIKLT
gb|ABM68334.2|         PAVPHFEIFGDLPIINVRDVPLDELRNILKRSFDVVFSLVAIIVTSPIMLLIAIGIKLT
RAAC01166              PARPRFETFGDVPLIDTRHVPLDDAVNAFLKRAFDIVFSLGVLIGLSPLLVAIAIAVKLS
ref|ZP_01372248.1|     PAKPQMDEIEGIPLININIRHVPLDNFLKAFAKRVFDVAVSFVGLVVCLPLFLIIIGIKLD
ref|YP_519555.1|       PAKPQMDEVDGIPLININIRHVPLDNFLKSFAKRAFDVAVSFVGLIICLPIFLVIIIGIKLD
ref|ZP_02234077.1|     PTKPYTEDLMGMPVINIRRVPLNNMLNAVAKRCVDILGALVAIILFSPVMLVTSIIIKVT
                       *: *   :  :  ..:*:*: *   ::   . ** .*:  ::   ::  *::: *  :*:

gb|AAR99615.1|         SPGPIIFKQERVGLNRRTFYMYKFRSM-----------KPMP-----------QSVSD
gb|ABM68334.2|         SPGPIIFKQERVGLNRRTFYMYKFRSM-----------KHLP-----------QSVSD
RAAC01166              SPGPVLYVQERVGKNRRTFKMYKFRTM-----------YWDPGADRAERDCAEEADLRS
ref|ZP_01372248.1|     SPGPIIFSQERVGLNKKNFMMYKFRTM-----------KEQSI----------EESD
ref|YP_519555.1|       SPGAVIFSQERVGLNKKNFMMYKFRTM-----------RMQSA----------EESD
ref|ZP_02234077.1|     SPGPLIFKQERIGKHNRPFYMYKFRSM-----------VVQDE----------KDEK
                       ***.::: ***:*  .:: *  *****:*                             . .
```

FIG. 6B

```
gb|AAR99615.1|      TQWTVESDPRRTKFGAFLRKTSLDELPQFFNVLKGDMSIVGPRPERPFFVEKFKKEIPKY
gb|ABM68334.2|      TQWTVENDPRRTKFGAFLRKTSLDELPQFFNVLKGDMSVVGPRPERPYFVEKFKEEIPKY
RAAC01166           AGWTVKGDPRRTRVGAFLRRTSLDELPQFWNVLKGDMSVIGPRPERPVFVERFREEVPRY
ref|ZP_01372248.1|  KEWTTENDDRKTRLGNLLRKTSLDELPQLWNVFKGDMSLVGPRPERPFFVEQFKEKIPRY
ref|YP_519555.1|    KEWTTKEDNRKTRLGNILRKTSLDELPQLWNVFKGDMSLVGPRPERPFFVEQFKEKIPRY
ref|ZP_02234077.1|  KGWTTKNDPRVTPIGRFIRKTSIDELPQLFNILIGDMSLVGPRPERPQFVEKFKEEIPRY
                    **.:  *  *  *  .*  ::*::***::*::  **:***  *:*::::*:* gb|AAR99615.1|      MIKHHVRPGITGWAQVCGLRGDTSIQERIEHDLFYIENWSLWLDIKIILLTITNGLVNKN
gb|ABM68334.2|      MIKHHVRPGITGWAQVCGLRGDTSIKARIEHDIFYIENWSLLFDIKIIFKTISNG-----
RAAC01166           MVKHRVRPGITGWAQVHGWRGDTSIAERIRFDIEYIENWSFWLDLKIVWKTIKHGFVNEN
ref|ZP_01372248.1|  MVKHHVRPGITGWAQVNGWRGDTSIRKRIECDIYYIENWTFMFDLKILVMTVFKGFVNRN
ref|YP_519555.1|    MIKHHVRPGITGWAQVNGWRGDTSIRKRIECDIYYIENWTFMFDLKILVMTVFKGFVNRN
ref|ZP_02234077.1|  MIKHQVRPGLTGWAQVNGYRGDTSIQKRIEFDLYYIENWTMGFDFKIIFLTFFKGFINRN
                    *:::**** *  ****  . *:  *****::  :*:**:    *. :* gb|AAR99615.1|      AY
gb|ABM68334.2|      --
RAAC01166           AY
ref|ZP_01372248.1|  AY
ref|YP_519555.1|    AY
ref|ZP_02234077.1|  AY
```

FIG. 7

```
ref|YP_001277643.1|  --------------------------RTGTEQYTCEVLAAIAR--LDTTNTYTLYCQR
ref|YP_001434357.1|  MRIGIDIS-------------RMATIARTGTEHYTGEVVAAIARR--DAVNTYTLYCNQ
ref|YP_001633727.1|  --------------------RVTVAQRTGTERYSYELIAALDRIAPSDIHF-RLYVNG
ref|ZP_01515212.1|   -------------------------RAGVSHYIEQVLLHLA--QIDHENRYTIYTTR
RAAC01167            MRMRIESTGSRLNRTVRIGVDCRPLVGDKTGIGYYLWEILDEWAR---AEIDFVELYLYA
ref|ZP_02291400.1|   ---------------MRISIDATGLGGPKTGTSVYLIEILSRWSRN-TSINHEFTIFASE
                                                 ::*    *   :::         .   ::

ref|YP_001277643.1|  --LPT-TLPPLGANMRM------RCIPLPRLWTHVRLSVEV-------LRHAPDVLFIPA
ref|YP_001434357.1|  --PPA-RLPSLGANMT-------VRCIPLPRLWTHVRLSGEV-------LRHPPDVLFIPA
ref|YP_001633727.1|  --RRD-QLPPVSE------RATIHDIRLPRLWTHLRLGPTS-------WRARPHVLFVPA
ref|ZP_01515212.1|   --GLDQAALGLPPNF------VVKPSRLPTINPRIRIPWEQGIAPFLL-RGKVDLYHGCL
RAAC01167            --SKPFELPSAFANTRLLYRKRVRRLSPGELWAQTALPVLV-------ARDGIDVFWGPN
ref|ZP_02291400.1|   --KAVSLCSEAGLDHRFRFVRAPNNRHIRVIWQQLMIPWHMR-------RLGIDVHWGTA
                                   .            :   :   :          *     .:

ref|YP_001277643.1|  HVLPLGAPLVRRMRTVVTIHDLGYLRYPEAHTTAQRLYLRLS-TVWSARAASHLIAVSEA
ref|YP_001434357.1|  HVLPLGAPLVRRMRTVVTVHDLGYVRYPEAHTAAQRLYLQMS-TIWSARAASHLIAVSAA
ref|YP_001633727.1|  HVVPLL-----HPPTVVTIHDVGYRAFPETHTARRRLELELT-TRWSLRAARHVITISHA
ref|ZP_01515212.1|   NVAPLLSP----VPTVITIHDLAFIRFPQTFRAYNRIYLDLA-TRLSARRASRILAVSEH
RAAC01167            FCLPLLCH----VPTVLTIHDMVYKVLPDTMMRKTYYHNAFG-LPLYARKSQKILVPSVN
ref|ZP_02291400.1|   FVLPVASQ----RPMAVTIHDLTFQLFPEVHERLKRFYFPAI-MQRSVAKAQAVFAVSRT
                       *:              .:*:**:   :   *:.          :  ::. * ref|YP_001277643.1|  TRNDLVRLAKVSPARVTVVHHGVADRFRQPVVD--LGRARKIAGGNE--PYFLYVGTVQP
ref|YP_001434357.1|  TRNDLVRLAGVSPNRITVVHHGVAERFRRALAD--SSRTRAITGGDE--PYFLYVGTVQP
ref|YP_001633727.1|  TKRDLINWYGADPNRITVTHLGCSSIFAPPADPRVVAAVTAHYGLDQR-PYLLYIGTVQP
ref|ZP_01515212.1|   TKREVAGLFGIPPERIVVTPNATRSHFRPFAAD-IIDQFRARKGLP--ARFILYVGTLEP
RAAC01167            TKLDVVKYLRVAEDRVVVTPLGMPKRFRQELDT--GIILSHRFGLEMG-SYILAVGTVEP
ref|ZP_02291400.1|   TETDLKRIIPESRGKTTVTLLAARKLGSDSQ------APRDQRNSGD---YLLFVGTLEP
                     *.  ::              :  .*.   .                    ::* :**::* ref|YP_001277643.1|  RKNLERVIEAFADASAQLTDGRTPVLVIAGKRGWLSERIAQRAAALGIADRVRFVGYVA
ref|YP_001434357.1|  RKNLARVIAAFADASRRLTGCGMAPILVIAGKRGWLSEGIARRAAEVGIADRVRFVGYVA
ref|YP_001633727.1|  RKNLSRVIDALALT----IAAGYDLDLVIAGKRGWLSEPIERRAGELGIANRVHFTGFVA
ref|ZP_01515212.1|   RKNLTTLLEAFALVSRRVPSVP----LLIGGGKGWMYQPIFARLEQLNLQDRVKFVGYIP
RAAC01167            RKNLERVVRAFRLARKAHPDMK----LVVAGTLGWASEQTQSALQDE----GVIYVGYVS
ref|ZP_02291400.1|   RKNLPRLLAAWQMLDDATRGNTR---LVIVGATGWMVSDLLQSLKTN---DTIDFLGHVS
                     ****   ::  *               *:: *   **  .            : : *.:.

ref|YP_001277643.1|  DEDLPALYRASLAFVFPSLYEGFGMPVLEAMACGAPVLTSNSSSLPEVAGDAALLVDPHD
ref|YP_001434357.1|  DDDLPALYHGALAFVFPSLYEGFGMPVLEAMACGAPVLTSNSSSLPEVAGDAALIVDPLD
ref|YP_001633727.1|  DADLPALLAGALAFVFPSLYEGFGMPVVEAMACGTPVITSTSSSLPEIAGDAALLVDPLD
ref|ZP_01515212.1|   EEELPLWYAAATIFVFPSIYEGFGMPPLEAMACGTPVITSNTSSLPEVVGDAGLMVDPAA
RAAC01167            DVELMALYKGCRFFVYVPLYEGFGMPPLEAMAVGKPVLTANNSSLPEVVGRAAILVDATR
ref|ZP_02291400.1|   DSSLAELMQGARALLYPSLYEGFGLPVVEAMARGIPLLTSNTGATAEIAEGAAILVDPTN
                     : .*    ..  :::.:*****.* :**** * *:.*:...: .*:.  *.::**.

ref|YP_001277643.1|  TGAIAAGMVRLARDEALREELQQHGYRRAAQFTWDRCAEETLRVL--------
ref|YP_001434357.1|  TGAIAEGMVRLVCDAALRQELRQRGYRRAAQFTWDRCAEETLRVL--------
ref|YP_001633727.1|  TNAIAAAIMRLSDDQDLRATLRQRGLARAHLFNWETCARQTLAVLL-------
ref|ZP_01515212.1|   PTALADAMMQLLTDADLHAALRQRGLERARRFSWTETAAKTLAVYREV-----
RAAC01167            EECIREGMSLLWVDGDLRERLSEQALARARKFSWDETAQKTLNVILNVVGAQT
ref|ZP_02291400.1|   VDDIRGGLVRLLTEPELLGALSAQGRERAKSFSWERTAQLTLETL--------
                       .:  *   :   *     *   :  ** *.*   * **  .
```

FIG. 8A

```
ref|YP_342776.1|        ------------------------------------------------------------
RAAC01170               MVSLTISLLADIYEGRHGFAGISTDMRTTYAGLASTADISLTGLIYAQRPLGNESVVRHL
ref|YP_001636830.1|     ------------------------------------------------------------
ref|YP_001324592.1|     ------------------------------------------------------------
ref|NP_780975.1|        ------------------------------------------------------------
ref|YP_001299026.1|     ------------------------------------------------------------ ref|YP_342776.1|        ---------------------YEMANQTYLRLGRLTRVK---------------
RAAC01170               LMMSRPDLMRLAHEIAGHRVPDNVFATMEHMLSGKRGMMLGDLSRVVRWALLTTRTYRTH
ref|YP_001636830.1|     ----------------------WQR-LRLPLRIEWFVGPLDIVH-------------
ref|YP_001324592.1|     ------------------------------------------------------------
ref|NP_780975.1|        ------------------------------------------------------------
ref|YP_001299026.1|     ------------------------------------------------------------ ref|YP_342776.1|        -----------------------------FPRPPALWHATTPL---PIRIRG--
RAAC01170               PIDSDVYYDLIWRFFFEKTLAPKELENVRQTQFVISGLSHAIGNATLKRWGRPLRLDARK
ref|YP_001636830.1|     -------------------------------APDFVLPPTKAR-------------
ref|YP_001324592.1|     ------------------------------------------------------------
ref|NP_780975.1|        ------------------------------------------------------------
ref|YP_001299026.1|     ------------------------------------------------------------ ref|YP_342776.1|        ---------------ARMVTTVHDLIPLRLP-YTTLDNKQFFYRLVRDALRDSDLVLTVS
RAAC01170               WDVVLTFNVSPIEFVGRRITRVHDLIPLVRPDFVPIEHAEIFKAQLELTLRNSQAIVTVS
ref|YP_001636830.1|     ----------------TLLTIHDLTFLVEPACAEPNLRRYLSTAVPRSLQRANLIIVDS
ref|YP_001324592.1|     ----------------KIITVYDVIPLQFPETYAKITVFRYKLLFSKTLNTSNKIISIS
ref|NP_780975.1|        ----------------KKIITVHDLIPYTMPETVGRGYLKKFLRNMPQLIYDADAIITVS
ref|YP_001299026.1|     -------------FKVKRIVTIHDLTFFIHPSVHTFIKRYYFRLFIKLACRYADRLICVS
                                         :   ::*:     *            . ::  ::   * ref|YP_342776.1|        ECSKRDILAFYDIPEERVVVT---------YQSLS----------LKKAST------H
RAAC01170               KCAAGDLVRLYPNTQSKIEIIPCATSRRY--YRDLSSIPLQR--IVERRLSEF------H
ref|YP_001636830.1|     KATAGDLGRLYGIPRQRVRLL---------YPAVDERF---------RPLTG------D
ref|YP_001324592.1|     HHTKQDLIKHFKISEDKIKVIH---------LAANENYK---------PLKE------N
ref|NP_780975.1|        KYSKKDILRFFPMDEKKIFVTH---------LAADEKY---------RPLNK------D
ref|YP_001299026.1|     ESTKKDLERICGRRSVSIDVIP---------LSCSPKMQ----------VGE------Q
                        .  : *:         : :                  .                    .

ref|YP_342776.1|        QRQSF--SVLKSYGLT--------------PGQYVLFVGNIEPKKNLATLIKAMSMLQH
RAAC01170               RHCRK--RDRRLPQIT--------------PFKYFIYHGTIEPKKNVKTLLLAFDSLVN
ref|YP_001636830.1|     AVVRV--RER----LH--------------LPARFLLFVGTLEPRKNLVRLLQAFALLQN
ref|YP_001324592.1|     EINN----IKQKYNLNYP---------------FILYVGTLEPRKNIPNLLKALYKL--
ref|NP_780975.1|        KCNYI---LKNHYNIDN--------------PFILYIGGFSPRKNIKSLLISF-SKIY
ref|YP_001299026.1|     ELELV----KKKFGVVSQ--------------YMLFIGTLEPRKNILNLINAFYKF--
                                                        :.::  *  :.*:**:  *:  ::

ref|YP_342776.1|        -----DLPLVVVGR-----KAWLWE-EQLQMAKRYFGSNEAK-RLRILDYVPSTVLSTLY
RAAC01170               QERFREYKLIIAGR-----FGWMYDQERTHMAK----LIEKG-AVIHLEDTTNDELRVLL
ref|YP_001636830.1|     E--YPDLHLLLAGR-----KGWLYDDIFAAVEQYHLSERVH-----FLDFVADEDLPALY
ref|YP_001324592.1|     KKHSIKHKLVITGK-----KGWKYKSIFETIEKLNLQKDVIF-----TGYVPDEDLPILY
ref|NP_780975.1|        KNLDKDYKLVIVGA-----NKNGTKILMDMAKDLNIESKIIF-----TGFVPEDHLPILY
ref|YP_001299026.1|     SQKNRDYSLVIIGK-----KGWFYESIFKLVEELHLERSVVF-----TGFVTTKEKFILL
                          *::   *             .      .              . .   *
```

FIG. 8B

```
ref|YP_342776.1|      SHALCMAFPSLYEGFGLPALEAMSHGCPVISSNASSLPEVCGEAALYMDPHDSDGLYAHI
RAAC01170             SNALAHVFPSYYEGFGIPPVEALSCGCPTIVSNVSSLPEVVGRAGILVSPYDAEWLASEM
ref|YP_001636830.1|   NLAEAFVYPSLYEGFGFPVLEALACGTPVVTTKVSSLPEVAGTAAIFVDPLEPEDIADGI
ref|YP_001324592.1|   NAADLFVYPSLYEGFGLPPLEAMQCGTPVITSNTSSLPEVVGDAGIMVNPYDVDELANKM
ref|NP_780975.1|      NSCETFVYPSLYEGFGLPPLEAMCCGTPVITSNVTSIPEVVGDGGILINPNDIDELSNSL
ref|YP_001299026.1|   SGAHSFIYPSIYEGFGLPVLEAITYGIPTITSKLSSLPEVAGNAALYINPYDVQSISDAI
                       .  .  :** *****:* :**:    * *.: :: :*:*** *  ..: :.* :  : :

ref|YP_342776.1|      ESL-LEDVCLRARLIEGGYRRVEYF-------SPERYAE--------------------
RAAC01170             G-----AVALAPESVRERIERESKY-------VLEQYAESTVRDKWMRVIEKSLSLGGRT
ref|YP_001636830.1|   R-----TALSNPASLR--------------------------------------------
ref|YP_001324592.1|   YEV-LTNDGIREELSKKGIERAKLF-------SWKKCAEEHLKVYEE-------------
ref|NP_780975.1|      EKT-LLDVSFKYELKKKALERSSLY-------SWENTAKNTL------------------
ref|YP_001299026.1|   ESVNCDEETRRKLIKNSEKQRLKY--------SWKKTANLTYSLYNRCGS---------- ref|YP_342776.1|      ----------------
RAAC01170             ASTLMAENYRVDSVL
ref|YP_001636830.1|   ---------------
ref|YP_001324592.1|   ---------------
ref|NP_780975.1|      ---------------
ref|YP_001299026.1|   ---------------
```

FIG. 9

```
ref|ZP_02170160.1|    ----------------AWITV---ILWGLV-------LIDTWIGFRRFPKLDS---FRE
ref|ZP_01171895.1|    ----------------AILLALCMIIWICA-------IADAFLGLRRLDQLEE---EEE
ref|YP_076646.1|      ----------------------------------------PNASLGPNPPP----------
RAAC01248             MFSNFVWSWLAHALPRAAWLPVLCAVVWTAI-------FLRTIPDLVRTPRLRP---REA
ref|ZP_02175410.1|    -----------ALALAGW----ARVAWSGL---------RSDRALARLEDLPA---PRS
ref|YP_590910.1|      -----IW-WHAHW---EALVAFAIGLVWLSR-------LLAASRGMPKLAEISR--PEWD
                                                                            :

ref|ZP_02170160.1|    TVLSPADRSGRVSVIVAARNEEDAIYESVKSQLTSTWPGVEWILVNDRSTDATGEKMDEL
ref|ZP_01171895.1|    LASGP-----LLSIVTAARNEAAVIEESIRTQLSQNYTHLEWILVNDRSEDGTGEIMERL
ref|YP_076646.1|      ----------RVSAIVPACNEARSIESAVRSLIRQDYPNLEVVLVNDRSTDGTGAIMDRL
RAAC01248             ARASPPSYG-RVSVVVAARDEREHIEVTLESLLRQTYPDLEIVAVDDRSTDGTGDVIDRM
ref|ZP_02175410.1|    VP--------RVSVVVPCRDEAPHVERAVRSLLAQDLPGLEVVAVDDRSRDETGAILDRL
ref|YP_590910.1|      LRPDPAP---RVSIVVCALNEEGKIEPALRSLLELDYPDYEVVAVDDRSTDRTGEIMDRI
                                 :*  : . .:*    :  :::.:  :    . *  : *:***  * **   ::.:

ref|ZP_02170160.1|    ARQD-----SRIRVVHVRDLPEGWLGKNHAMHCGYEEATGSALLFTDADVMFRPHTIEGA
ref|ZP_01171895.1|    AQED-----ARIRVLHIHDLPDGWLGKNHALCRGAGMAKGDIILFTDADVMFRKDAIGRA
ref|YP_076646.1|      AREF-----PQVTVVHIDRLPAGWLGKNHALWVGARHASGEILLFTDADVHYDPTTVRRA
RAAC01248             AASD-----SRIVPVHIRELPRGWLGKNHALYAGAMRATGDWLLFADADVRFYPDAVERA
ref|ZP_02175410.1|    AAAE-----PRLAVVHVRELPAGWLGKNHACAAGARRARGEWLLFTDGDVVFGPGALRRA
ref|YP_590910.1|      AEEYRANAHHHLRVVHVTELPPGWLGKVHAMWSATRVADGDWILFTDADVVFQKETLRRA
                      *           ::   :*:   *     . * *. :**:*.**  :     :: * ref|ZP_02170160.1|    MACKKTTGARHVTMTPEMTVKTFWTQAFVHFFLFGFSYYKRPWKANDDRSKIALGIGAFN
ref|ZP_01171895.1|    LSYFRRQGLDHLTAAPALKAHSFWLKAFIGFFLFGFSYYKRPWQANRPQSKTGIGIGAFN
ref|YP_076646.1|      VAFMEQRRLDHLTLAPDLTVRGYWLEAWVGFFVMAFLAYKTPYRANDPRSKVGTGIGAFN
RAAC01248             MAYVHARRLHHLTVAPRLIASGYALKLLTAMYIFNYVLFKRPQSAYRRRTRAHAGIGAFN
ref|ZP_02175410.1|    VGHAEALGLGHLAAAPRFVAPGALERAFVAAFAAFAAGAFRVWELPRAGTRGFAGVGAFN
ref|YP_590910.1|      IAYAERERADHVVLFPTMLMYTWDERMMIAFFQAMFVFGHRPWKTADPKSRDHMGVGAFN
                      :.  .        *:. * :           .    :           ::    *:**** ref|ZP_02170160.1|    LIDREAYEAIGTHRAIRLRPDDDLMLGVRVKAAGMRQRAIDGTGGLSVEWYPSLKEAVKG
ref|ZP_01171895.1|    LISKKAYEDAGTHESIRMRPDDDLMLGMLMKRLGYRQKIAAALELLEVEWYTSLGEAFRG
ref|YP_076646.1|      MIRRTAYEAIGTHRAISLRPDDDLRLGQRLKRMGHSSHVAMGRGLVSVEWYTSLREAIRG
RAAC01248             LVSREAYERIGTHRAISLRPDDDLHLGKLIKRHGFRQRFVVAQDMIEIEWYPSFRAMVVG
ref|ZP_02175410.1|    LVRRDAYEAVGGHARLRLEVVDDVKLGLLLRRSGVPQGLVNGGALVSRWQHGFVPSVLG
ref|YP_590910.1|      LIRRSVYEKIGTYARMKMAVVDDMKLGEIVKKEGYAQRNVFGRDLIQLHWHSGALGVVRG
                      ::   .**  *  :  :   :   ::   *  .       . :.:.*  .    . * ref|ZP_02170160.1|    LEKNTFAGLHYSWLMVLFALSGVFVSQVLPFIGVLFHEG---SARWVYLAAVVLMLIIY-
ref|ZP_01171895.1|    LEKNTFAGLHYRISMVLLAIAGTFISQVVPFF-AVFSPD--RLVMGLSAANIILLGGLYT
ref|YP_076646.1|      LEKNAFAGLEYNLGTVFASVVGILAIMVWPYVALFLTEG---WTLGLYAGAILLQLALYV
RAAC01248             MEKAPLPAFHYSAVLLTAAMMVMMVLYTTPFAGAIFGPG---WYRLVYLYCLVLMGILYE
ref|ZP_02175410.1|    LVKNAFAGAEYRVARALGVALWAVFLGAAPLALALAAHG---GAARALGGLALAVSVGVLG
ref|YP_590910.1|      LTKNFFAILRFNPFLTLGVILGMLLFNLTPFVGVFLTHG---WARAGYALALASIAGIYY
                      : *   :.   .:              .    *          :

ref|ZP_02170160.1|    --VKTSFAPWKKALKTFTVFPLSALIPIYTLIRAVLKTVIRGGIEWRGTFYSLKELKK--
ref|ZP_01171895.1|    M-ISNRMTPFSSAL--FLVFPLTALLFIYSIMRASFLTFKRGGIVWRGTKYSLKELRR--
ref|YP_076646.1|      L-ANGAGGPRMCQL--ALAYPVAALLFAYAIARATYLTLRRGGIAWRGTFYPLALLR---
RAAC01248             L--HAVFLRLPKHQ--FLILPLGMLLYSYAFIRSAVLAVRRGGLVWRDTFYTLRELRRGL
ref|ZP_02175410.1|    VTARRVAGGGGAEG---LLMPPCTVLLGAVLLASAAAAAWRGGVVWRGTFYPLAALRQG-
ref|YP_590910.1|      GMSDRSTIPWYYVV----LHPVSTVLFAYTVGRSMVVTLAQDGITWRGTHYSLNELRKGV
                                         *     ::   .  :    :.*: **.* *.*   *:
```

FIG. 10A

```
gb|AAW77167.1|     ----------------------------------------------------------
ref|YP_452722.1|   ----------------------------------------------------------
ref|ZP_02241787.1| ----------------------------------------------------------
ref|ZP_01643350.1| ---------------------------------------------------------Q
ref|ZP_01665289.1| ----------------------------------------------------------
RAAC01348          MNFANEKFRLSLGHVPSEMHCAQHIRIEARGAVREFARSGAGTRPDRRGGSSSPVRSKRR gb|AAW77167.1|     ----FAFFYPIMMAFFWISGGLYYFLRRERKSRPRNDPPPMGHYPSASLLIPCHNESDNL
ref|YP_452722.1|   ----FAFFYPIMMAFFWISGGLYYFLRRERKSRPRNDPPPMGHYPSASLLIPCHNESDNL
ref|ZP_02241787.1| ----FAFFYPIMMAFFWISGGLYYFLRRERKSRPRNNPPPMGHYPSASLLIPCHNESENL
ref|ZP_01643350.1| VLFQFAFYYPMVMAFFWMSGGLYYYFRRERHSRPRNDPPLMIDPPFASLLIPCHNESENL
ref|ZP_01665289.1| ----FVFYYPLVMSIVWIVGAFYFYLRREAG--RRRRPPVLAEYPLVSVLIPAHNEEQSI
RAAC01348          MVHSFLFLYPFVMSIVWMVGGCVYAWRRERH--PFAESPDLPETPFVSILIPCHNEGDVL
                        * * **::*::.*: *.   :    ***      .* : .* .*:***.***  : :

gb|AAW77167.1|     DDTIGNALAQRYP-DFEVIAINDGSRDDTGARLDILAARHPRLRVIHLDRNLGKANALRM
ref|YP_452722.1|   DDTIGNALAQRYP-DFEVIAINDGSRDDTGARLDILAARHPRLRVIHLDRNLGKANALRM
ref|ZP_02241787.1| DDTIGSALAQRYP-DFEVIAINDGSRDDTGARLDILAARHPRLRVIHLDRNLGKANALRM
ref|ZP_01643350.1| DDTLGAALAQRYPADYEVIAIDDGSSDDTGARLDALAAKHPRLRVLHLDRNLGKANALRM
ref|ZP_01665289.1| RATIASVLKSNYP-NFEIVVVDDGSTDATPRILLELAAECPAVRVLIMKQNMGKPSALRY
RAAC01348          EDTIGRMLQLDYP-AYEIVALNDGSTDDTRAVLERMAACDARVRVVNLPVQRGKARALNA
                    *:.  *      **   :*::..::*** * *   *   :**    . :**:   :  **. **.

gb|AAW77167.1|     GALAARSEYLICIDGDAMLEEFAMHWMVWHLSS--SPRVGAVTGNPRIRNRSTLLGRLQV
ref|YP_452722.1|   GALAARSEYLICIDGDAMLEEFAMHWMVWHLSS--SPRVGAVTGNPRIRNRSTLLGRLQV
ref|ZP_02241787.1| GALAARSEYLICIDGDAMLGEFAMHWMVWHLSS--SPRVGAVTGNPRIRNRSTLLGRLQV
ref|ZP_01643350.1| GALAARSEYLVCIDGDAMLEEHALHWMIWHLVS--GSRVGAVTGNPRIRNRSTLLGRLQV
ref|ZP_01665289.1| GLMACRGEIILAMDADAFLDANAMRWLVAHFVA--GPRVGAVTGNPRVRNRTSLIAKIQV
RAAC01348          GLVASRGEILVTVDADAVLAKDALRFLVWHFVAPGSERVGAVTGNPRIRNRGTLLGKIQV
                   *  :*.*.*  ::   :*.**.*    *:::::  *: :    . **********:*** :*:. ::**

gb|AAW77167.1|     AEFSSIIGMIKRAQRVYGRIFTVSGVIAGFRRTALHRIGYWADDMMTEDIDISWRLQLDH
ref|YP_452722.1|   AEFSSIIGMIKRAQRVYGRIFTVSGVIAGFRRTALHRIGYWADDMMTEDIDISWRLQLDH
ref|ZP_02241787.1| AEFSSIIGMIKRAQRVYGRIFTVSGVIAGFRRTALHRIGYWADDMMTEDIDISWRLQLDH
ref|ZP_01643350.1| AEFSSIIGMIKRAQRVYGRIFTISGVIAGFRRTALHQVGWWSDDMVTEDIDISWRLQRAH
ref|ZP_01665289.1| GEYSSIIGMIKRTQRILGKVLTVSGVIAAFRKRALLDVGLWDIDMITDDINVTWKLEKHF
RAAC01348          LEYASIIGLIKRAQRVLGKIMTVSGVIAAFRKRALVDCGMWDEDMVTDDIAVSWKLERRA
                    *::****:***:**: *::*****.**: *:::*:*****.**: ** * * **:*:** ::*:*:

gb|AAW77167.1|     WDIRYEPNALCFILMPETLKGLWRQRLRWAQGGVEVLLRHGRSLFSWRKRRMWGVLLEYI
ref|YP_452722.1|   WDIRYEPNALCFILMPETLKGLWRQRLRWAQGGVEVLLRHGRSLFSWRKRRMWGVLLEYI
ref|ZP_02241787.1| WDIRYEPNALCFILMPETLKGLWRQRLRWAQGGVEVLLRHGRSLFSWRKRRMWGVLLEYI
ref|ZP_01643350.1| WDIRYEPNALCFILMPETLKGLWRQRLRWAQGGVEVMLRHARSLLHWKERRMWGVLLEYV
ref|ZP_01665289.1| WDVRYEPNALCWILVPETLKGLWRQRVRWAQGGVEVIRRHAGIWTDWRQRRLWPVYIEYV
RAAC01348          WDIRYEPRALCFMWAPERLRSLIRQRARWAQGGVEVLIRNASVLWTWKNRRMIPLYVEEL
                   **:****.***:: :  ** *:.* *** *********: *:.       *::**   : :* :

gb|AAW77167.1|     LSVLWAYSIVLIAVLWAPRQFFALP-TAVSIHGLLPQWHGAAMVLVCLLQFASSLIIDRR
ref|YP_452722.1|   LSVLWAYSIVLIAVLWAPRQFFALP-TAVSIHGLLPQWHGAAMVLVCLLQFASSLIIDRR
ref|ZP_02241787.1| LSVLWAYSIVLIAVLWAPRQFFALP-TALSIHGLLPQWHGAAMVLVCLLQFASSLIIDRR
ref|ZP_01643350.1| LSVVWAYTMLFIVVLWALGKFIEMP-PQLYIASLLAQWHGVILALVCLLQFASSLIIDRR
ref|ZP_01665289.1| ISVCWSYAFVSFGGLWLLNFIFPHD---LPVAKIFPEWKGAVLVSLCLVQSAIALWIDRR
RAAC01348          LGIAWAYLWVVS-LVWTLAFDVAHG---IPWT--YVAETGTWLGLTSLVQTSVALWIEQR
                   :.: *:*   :      :*         .   :       *. :   .*:*  : :* :*
```

FIG. 10B

```
gb|AAW77167.1|        YEK-GIGRNYFWVIWYPIAYWLLSLCTTVVALPKTL----LTRRGKRAIWVSPDRGI--
ref|YP_452722.1|      YEK-GIGRNYFWVIWYPIAYWLLSLCTTVVALPKTL----LTRRGKRAIWVSPDRGI--
ref|ZP_02241787.1|    YEK-GIGRNYFWVIWYPIAYWLLSLCTTVVALPKTL----LTRRGKRAIWVSPDRGI--
ref|ZP_01643350.1|    YE-TQIGRNYFWVIWYPMAYWLISLSTTLVALPKTL----LRRRSKRATWTSPDRGI--
ref|ZP_01665289.1|    YEKNILW-YYFWVIWYPFVYWVISALATVWAAPR---ALFGHSKGKLAVWQSPDRGL--
RAAC01348             YERDSLWRYYFYAIWYPAAYWMIGAFVVVWAVPKACWAMWAARRGRYATWKSPDRGVSA
                      **   :   **:.****  .**::.   ..: * *:        :.: * * *****:
```

FIG. 11

```
ref|YP_001395809.1|    ---KDSITVSLCMIVKNEEDTIGRCLDSVKDVIDEFIIVDTGSSDNTKDVIKKYTDNIYD
ref|YP_001309701.1|    -------TISLCMIVKNEEDVIANCLESVKDIVDEMIIVDTGSDDKTKKIVKRYTDKIYD
ref|YP_001643660.1|    -------TISLCMIVKDEEQTISKCLESVKSVVDEIIIVDTGSTDGTKEIVKKYDAKVYD
ref|YP_520670.1|       ---------SLCMIVRNEEKTIARCLDSVCDIADEIIIVDTGSTDRTKEIVARYTDKIFD
ref|YP_147952.1|       -------TISLCMIVKNEEDVLARCLDSVQHLVDEIVIVDTGSTDRTKEIARSYTARVID
RAAC01377              MSAKTENTWSLCMIVKDEEAVLDRCLQSIADIVDEIVIVDTGSQDRTQEIARKYTDLVFD
                                ****::  .:  .**:*:     : ::****  * *:.:       *   :  * ref|YP_001395809.1|    FEWIDDFSAARNFAFSKATKDYIFWLDADDVLLPEDVEKFKALKKNLDTSIDSVTMRYNV
ref|YP_001309701.1|    FKWIDDFSAARNFAFSKATKDYILWLDADDVVLPEDGEKFKDLKETLDPTVDSVTAKYNT
ref|YP_001643660.1|    FQWIEDFSAARNFAFSKATKEYILWLDADDIIDTEDIKKLLQLKHTLDRSTDAVSMKYYL
ref|YP_520670.1|       FAWIDDFAAARNYAFSLGTKEYLLWLDADDVILESDRLKFHNLKKNLNPSIDVVNMHYLL
ref|YP_147952.1|       FPWSDDFSAARNFSFSHATMDYIFWLDADDILPAEEQTKFLTLKRTLSSDIDSVTMIYSL
RAAC01377              FEWVDDFSEARNESFRHASMDYVLWLDADDVVSDVDRIKLAEFKKNLSSDVDAVTMWYHL
                        * *  :: *   :*    .: :*::******::    : *: :*...*.  * *. * ref|YP_001395809.1|    SFDEYSNVTTSYRRNRLVKKEKNFKWIGFVHEYLEVYGNIINSEISVTHKKINYSPNRNL
ref|YP_001309701.1|    AFDEYGNVTASYRRNRLVKRSNNFQWFGFVHEYLAVGGNIINSEIAITHRKLKQTPKRNL
ref|YP_001643660.1|    TFDIEGNPTHSLRRYRLVNRSKNFQWYGFVHEYLEVYGNLINSDVGVSHKKEKAYTNRNL
ref|YP_520670.1|       AFDSSENPTFTLRRNRLVRRGKNFRWKGAVHEYLEVSGNIMNSDIAIAHKSEEHDSERNL
ref|YP_147952.1|       AQDEYGKTISSVRRNRLVKRSSGFRWHGMVHEYLEVWGTILNSDITIIHQPNRCASDRNL
RAAC01377              AFQGDQPTVSS-RLVRLVKRSRGFVWRGRVHEYLEINGNILNSDIAIIHRPVEHDAARNL
                        : :      :  *   *** .:  .* *  * ***** : *.:::**::  . *:   . .  *** ref|YP_001395809.1|    EIFQNKLKEGVEFTPRDILYYGNELYEHRMFEDALKYYNDFLDSKRGWYEDNIHVCGKIC
ref|YP_001309701.1|    EIYQNKLKEGVVFTPRDILYYGNELYDHRMFDEALQYYNKFLDSKQGWFEDNIRVCEKIC
ref|YP_001643660.1|    KIYEKHLESGKEFSPRDVYYYANECKDHRLFDKAVKGYSRFLDEEKGWVEDNIQACLKRA
ref|YP_520670.1|       RIYEKRLEQGEEFSPRDLYYFANELYDHKQYEKAVEYYEKFLNTEKGWVEDNISACGKLA
ref|YP_147952.1|       QIYEKQLAQGKEFSPRDLFYFANELFDHQQYERAIQYYEQFLQTKKGWVEDCIAACGKVA
RAAC01377              RIYEKKLALGEDFSPRDMLYYANELLDHAQYEKAVQWYKRFLATGQCWKEDAITACFKLA
                        .*::::*  *  *:***: *:.**  :*   ::  *::  *. **   :  *  **  .* .

ref|YP_001395809.1|    DYYQSINNGEECRKYAFKSFEYDSPRAEACCRLGFSFLQENKINQAIFWYETAANLKKPI
ref|YP_001309701.1|    DYYQSIDKVEDGRRYAFRSFEYDTPRAEACCKIGFSFLHEKKYKQSAFWYEQATKLEKPK
ref|YP_001643660.1|    ECYLELGDLKKSIQSCLQSFTYDTPRGELCCHLGRVFLQQGEYSKAIYWYHAAIDGPRPK
ref|YP_520670.1|       DIYKLLGDSANAQAYLYKSFDYDTPRAEFCCRIGFNHLNAGKYQQAIFWYKLASELEKPT
ref|YP_147952.1|       DCFDALGDEEQALRYALRSFEYDTPRAECCCRLGYYFLQRKQYRLAAFWYHLATQLTMPS
RAAC01377              ECFRAMNQPEQSKQAVLHSFLYDTPRAEACCRIGYGYLEEGKIDQAIFWYDLATKCRRPA
                        :   :    :.. .          : :**.* **::*   .*.   :    : :**. * . * ref|YP_001395809.1|    NSLGFFSDACWTWLPHLQLCVCYDRIGKHQLAYEHNEIAGKFRPNDKKILYNRNYFQS--
ref|YP_001309701.1|    DSWGFFNDACWTWLPHLQLCVCYDRLGDHNLAYEHNEIAAKFRPNDSRILYNRNYFKS--
ref|YP_001643660.1|    D-SPFVREECHTWLPHIQLCICYDRIKEYEKAIYHNEQAALFIPNNPSIEYNR-------
ref|YP_520670.1|       NSWGPKSEACWTYLPHLQLCVCYDRLGMHELAYKHNEIARDYRPDNPQILHNKKYL----
ref|YP_147952.1|       DSWGFVHHACWTWLPHLQLCVCYFYMGEYELAYQHNEKAKQYVPHHPAVLHNECLLQSIL
RAAC01377              NFVGFVNHACETWLPHIQLCVCYSRLGQYRKAYDHNERAAEYLGEDPMIVHNRSVLRAWM
                        :          . * *:***:***:**   :  :. * *** *  :    .   : :*.

ref|YP_001395809.1|    -------
ref|YP_001309701.1|    -------
ref|YP_001643660.1|    -------
ref|YP_520670.1|       -------
ref|YP_147952.1|       AAE----
RAAC01377              DGELEKP
```

FIG. 12

```
ref|NP_865262.1|        --LKIAFVGDYLPRKCGIATFTHDLRIGVARE------TCAECIVVTLDDIE--GGYAYD
ref|YP_426013.1|        ----IAFIGNSLPRRCGIATFTTHLRQAV----GT-RFADIETFIVAMTDPG--QDYAYP
ref|ZP_01885526.1|      --MKIAYISSYPPRECGIATFNHNLMRAIGHD---KSAVSEDSFVVAMNDSDSITTYEYP
ref|YP_146214.1|        --IRIAYVSTYPPRRCGLATFTEHLRQSIDGVR---GPSDGDRVIVLYNESDGDDAYRH-
ref|YP_001124463.1|     ----IAYVSTYPPRRCGLATFTEHLRQSIDSVR---GKVEGDRVIVLYNEIDGDDAYRG-
RAAC01611               MTLEIGYVSTYVPRKCGLATYTHHLRQSVRRAA---GPSAADQVIAMLAP--DEDVKNY-
                             *.::.  **.**:**:.  .*   .:         :  ..:.

ref|NP_865262.1|        NEVQFQVADQELDEYQSAADFLNFSNVDVISLQHEFGIFGGPCGSHILALLQDVRMPVVT
ref|YP_426013.1|        ASVPIEVHQDRLEDYLHAADLLNDGNVDIACLQHEFGIFGGEAGENILALLGRLTMPIVT
ref|ZP_01885526.1|      KEVKYIIRQENQKDYIRAADYINTSLADACILEHEFGIFGGESGVYILPLLARLKKPLIT
ref|YP_146214.1|        NPAYWPLPAQNRAAYAEMAKRVNESDIDVVLLQHEFGIFGGEAGEYILDFIAALNKPLVT
ref|YP_001124463.1|     NPAYWPLPAQNRAAYEKMARRVNESDIDVVVLQHEFGIFGGEAGEYILDFIAALQKPLIT
RAAC01611               NRSYWFLRRDERRDYARIARRVNDSRIGVVSLQHEFGIFGGEAGSYILDFIDALDKPLVT
                          :   :.    *    *  :*.  .    *:********  .*  **  ::  *::* ref|NP_865262.1|        TLHTVLSEPNEAQRAVMMQLIRLSTRLVVMTERSRQTLLDTYSVDSDQIDVIAHGIPEAP
ref|YP_426013.1|        TLHTVLDQPTPAQRDVLDRLFALSAKLIVMAQKARELLRTVYRVPADKIEVIAHGIPDFP
ref|ZP_01885526.1|      IFHTILKDPSYMQLTIIREIAKYSSRIVVMSHRAVGFLTGIYGIPFAKIQLIEHGVPDLE
ref|YP_146214.1|        TFHTVFADPPLPYRPIQEKIAAASDAIIVMNRQAIPYLVKAFGLPEEKIVYIPHGAPGPS
ref|YP_001124463.1|     TFHTVFAAPEPPYRPIQEKIAAASDAIIVMNRQAIGYLVKAFGLPEEKIVYIPHGAPGPS
RAAC01611               TFHTVFQKPMSPYREVQKEIAERSDRIVVMNRQAIDYLVDAFGISPSKIHYLPHGTPVRS
                        :**::  *       :   .:  *  ::** .::    *   : :  :*   : ** * ref|NP_865262.1|        ETDQSVLKEQFGVEDKPVALTFGLLSPGKGIEHVLKAIPEIVAKFPDFIYIILGATHPSL
ref|YP_426013.1|        FVGSEKAKAELGFSGRAVILTFGLLSPNKGIEVMIDAMPAIVKSRPDAVYVVLGATHPNL
ref|ZP_01885526.1|      AKTDNPVRQSLAFKGKKVLFTFGLISRNKGLETVIEALPEIVAQHPDVMYVILGTTHPGV
ref|YP_146214.1|        SENRDSLRRRLGFSGRKVMLTFGLLSRGKGIESVLAALPGVVRKVPEALYVIAGQTHPEV
ref|YP_001124463.1|     SEERQSLRSRLGFHGRKVMFTFGLLSRGKGIESVLTALPGVVRKVPETLYVIAGQTHPEV
RAAC01611               VTPRAELRKQFGWQDRAVIVTFGLLGPSKGIEFMLDAMPDIVREVPNALYVIAGQTHPEI
                          :    :.. .:  *.****:.  .**:*  ::  *:*  :*  . *:  : *** :

ref|NP_865262.1|        LREQGERYRISLERMAKELGVSKHVSFYNRFVELEELTEFIGAADLYITPYLNVEQAVSG
ref|YP_426013.1|        VREQGEAYRDSLRARVQDLGLQDHVVFLDRFVDQDTLLRFISMCDIYATPYLNLAQMTSG
ref|ZP_01885526.1|      VRNSGEEYRDSLKRLAQKLNVEENLTFINKFVSEGELFDYLTACDMYITPYLNEAQITSG
ref|YP_146214.1|        KKREGEAYREELKSLIHRLGLELHVYMEDRYFSEEELIDYLTACDLYVTPYPGMQQITSG
ref|YP_001124463.1|     KKREGEAYREELKALIHRLGLDDHVRMEDRYFSEEELIDYLTACDLYVTPYPGMQQITSG
RAAC01611               VKREGEAYRESLMRRIHELHLDDHVVMLNQYMSESDIVDLITAADLYVTPYPNMEQITSG
                         :..** **  .*       : * :. ::  ::::..   :      .*:* *** . *.**

ref|NP_865262.1|        TLAYAFGCGQAVISTPYWHAEELLADGRGVLVPFADPSAIAREVIGLLSDDDRRLAMRDK
ref|YP_426013.1|        TLAYSFGLGKPVVSTPYWHARELLADGRGILVPFGDAGAIGLAIAGLLTDDARREAMAER
ref|ZP_01885526.1|      TLSYAVGAGAAVVSTPYWHAQELLADNRGRLFDFKDSHALANNVNELLSDKQKLSELKGN
ref|YP_146214.1|        TLAYAVGVGRPVVSTPYEHARDLLQGCEELLLPYGDTTAWEERLGQLLADEAALKRWEEK
ref|YP_001124463.1|     TLAYAVGVGRPVVSTPYEHARDLLQGCEELLLPYGNTSVWEERLVQLLADEAALERWERI
RAAC01611               TLAYAVGMGQVVLTTPYAYARDLLKDVPELLVPYGDTRAWADRAVEILTNRDVRAKYAER
                        **:*:.*  *  *::***   *: :**  *.  :   .      :*::

ref|NP_865262.1|        AYDLGRDMTWEHVS----QLYIDSF-----NRAR-DQRTSSLKPLAV---
ref|YP_426013.1|        AYIGSRSMIWQRSA----ERYLDVF-----TAVLQDRQVHEAAPVE----
ref|ZP_01885526.1|      AYEYGLHLRWPSTG----QVFVDV--------------------------
ref|YP_146214.1|        VRQIGANTHWPRVG----EQHVALF---ARMCDAK---RGEVKTIGTVSH
ref|YP_001124463.1|     VRQIGANTHWPRVG----EQHIALF---ERVCTAA--NSGEVKAVDFVSH
RAAC01611               ISAIGADMTWPRVG----ERHWQLF---QDVALRARHRASGVKGFAVIAH
                            .        *         .     :.
```

FIG. 13A

```
ref|YP_146215.1|        ----------IKFDHLERMTDDTGLLEHSLGRIPRRREGYSTDDNARAIWACLEWMALCE
ref|YP_001124464.1|     -----------------MTDDTGLLEHSLGRIPRRREGYSTDDNARAIWACLEWLALLK
RAAC01612               MRSSHTDGLPVSLDHLRRMTDDTGLIEHAIGRIPRRQEGYSTDDNARALWLAYEWLHYAR
ref|YP_074948.1|        ------------LSHLQRLTDPTGVIQHAVGPIPNLTTGYTSDDNARAL-LVSVWAARAG
ref|YP_001039503.1|     ------------DHIFRMTDDTGMLQHSKYSLPDPNHGYTTDDNARALIMALMLYKKYG
ref|NP_621770.1|        -------------HLFTLTDDTGIFQHSLYSIPDPSKGYTTDDNARAAIAATMLYQVYR
                                  : ::*:     :*      ::**** ref|YP_146215.1|        DKG---EKER----------LHRLLDRYLAFLLWAQNDDGTFHNNFFFDRTKEEETPSD
ref|YP_001124464.1|     NRE---MEKR----------LYRLLDRYLAFLLWAQNDDGTFHNNFFFDRTKEEETPSD
RAAC01612               ERG---LEAEAA--------DLARLIDIYFAFLAWVQKPDGWFHNNVSYDRRFELEVPSD
ref|YP_074948.1|        EA-----------------TAQLSETYLAFLAYAQRPDGWFHNAFSYDRNPLAEDRSE
ref|YP_001039503.1|     E------KKYLD--------LVYR----YSSFLLNAQNEKGKFKNFMGYDRKWLEDEGSE
ref|NP_621770.1|        E------EVYLS--------LLRR----YLSFLIYAQNEEGFFRNFMNYNREFTEKKGSE
                        :                :       *  :**  .*.  .* *:* . ::*     . *:

ref|YP_146215.1|        DCFGRSFWATALAY----VRLSDPARREAAADMLRRAMP------AAWELRSLRGVAWGV
ref|YP_001124464.1|     DCLGRSFWAVASAY----IQLNDPARCEAAADMLRRGMP------AAWKLHSLRGIAWGL
RAAC01612               DCQGRSVYALAVGM----CEERDPARLTAYAQVLRRGLE------AALRLTHARGVAHVV
ref|YP_074948.1|        DCQARCLWGLAAAA----TQLGGSSVAWTAAHLFRRGLA------PCGSVRTLRGRAGVA
ref|YP_001039503.1|     DCFGRCLWAIGFAL---SGDFTPRGVKHALLEIFNKAMP------HAANLSYLRGKAYSA
ref|NP_621770.1|        DCFGRSLWALGYLL---NVPFSDESYHNVAIRLLEKAL------FNVKKLYSLRGKAYSL
                        **  .*..:. .                  .      ::.:.:        :    ** * ref|YP_146215.1|        ATCGV---------LLTEGRPL--GVDQE-----------EVAALAARLEQRL------
ref|YP_001124464.1|     AACGL---------LLEKASPP--GVDKE-----------ELATLAGRFERRL------
RAAC01612               AAAARLLRHAEGVELPEDAAPEFWAFVRQ-----------RLPGVVERGARDL------
ref|YP_074948.1|        VAMAEWLEH-----RRADGRPD--GAPTD-----------DEVRAHLIRAADGL------
ref|YP_001039503.1|     IGLSFF---------------DGDDSKE-----------LVFSIAQSL------
ref|NP_621770.1|        IGLSLIYNS--------EAFEFDRGEIRD-----------LVKSLSQDL------
                                 .                 :                           * ref|YP_146215.1|        -----LAAYWEHAGDDWYWYEPELTYANGVLPWALWTAYRRAPRDEVKEVAEKSLAFLIE
ref|YP_001124464.1|     -----LEAYWTHTDDGWRWYEPELTYGNGVLPWALWTAYRRAPRQEVREVAEESLAFLIE
RAAC01612               -----VSRFEAHARGDWPWFEDRMTYDNAVMPWALFEAYALTGEARWREVAEASLDGLLA
ref|YP_074948.1|        -----TDAWKQHATRDWAWFEDRLTYDNALLPYALLRAGRILDVPEYRRIGLTALE-FLA
ref|YP_001039503.1|     -----CCQYDEHKDGEWKWFEDVVSYCNSVLPWSLLTAYKVTGEKRFLETAEESLD-FLG
ref|NP_621770.1|        -----LKSYYKNREENWKWFEDQMTYSNAILPWSLLKAYTVTKDEEVLRVAKESMD-FLG
                             :      :       * *:*   ::* *.:*::*  *       .        .  . ::  ::

ref|YP_146215.1|        KMSGPGGVIRPVGNRGWCSRR-YRADWDQQPLDVMKLALAAREAYWATDDERYRGVVRRC
ref|YP_001124464.1|     MMSGPEGTIRPVGNRGWCSRR-YRADWDQQPIDVMKLALAAREAYWATEDERYRDVVRRC
RAAC01612               RMRAPEGWLRPIGNRGFAAPG-FTAIWDQQPLEIAQLAIACESAWRATGDTAYRRLTAEC
ref|YP_074948.1|        GATFRDGVFWPIGNDGWYVRGRRAEFDQQPLEATAMVLACQEAGAVTGDKVWHGMALDA
ref|YP_001039503.1|     KITFKDGYFKPVGCNGWFKKGKEQAEFDEQPVEACEAVLTYLEAFELTGKTKYLEKAKIC
ref|NP_621770.1|        SVTFKDGYFKPIGCKGWYKKGGKRAEFDEQPIEACESALMYIEAYRVFGEEEYLNKAKKC
                          *  : *:*  *:            * :*:**::    .:   .*             .  .

ref|YP_146215.1|        LAWFYGQNDGNAPLADPSDGSCCDGLGPNGPNPNRGAESTLSYLLT--------------
ref|YP_001124464.1|     LAWFYGKNDGNVPLADRSDGSCCDGLGPNGPNPNRGAESTLSYLLT--------------
RAAC01612               QRWFYGENDKGVPMADPADGSCCDGLTPQGPNLNRGAESTWSYLITEIHVERAFADDLDA
ref|YP_074948.1|        ARWFTGRNALGVPLLDPETGGCHDGLNPHGVNRNQGAESTLAWLMAAYGLE---------
ref|YP_001039503.1|     NAWYSGMNSKGIPLVDPETGGCYDGLTQKGVNLNMGAESLVSYIIS--------------
ref|NP_621770.1|        YRWFLGENSQNISLVDEETGGCYDGITEDGVNLNEGAESLISLIMTDMVV----------
                         *:  *  *      ..: *    *.* **:   .* *  * ***       :   ::::
```

FIG. 13B

```
ref|YP_146215.1|       ------------------------------
ref|YP_001124464.1|    ------------------------------
RAAC01612              ARAFGAWVGVPRQTLVSARSRRALGGFHR
ref|YP_074948.1|       ------------------------------
ref|YP_001039503.1|    ------------------------------
ref|NP_621770.1|       ------------------------------
```

FIG. 14A

```
ref|YP_001038202.1|    --------------MQVVIFIAGCYFFGISIFG-WIKRRETSPKEYVPQKKFALIVAAHN
ref|ZP_01575301.1|     --------------IQILIFIAGCYFFGISIFG-WVKRRQKSPQNIIPTKRFALVVAAHN
ref|ZP_01667587.1|     ---MNYIFDYIMIPMQLIIIFFTLYYFIIAIFG--IWRRKEE-KITTPEKSFAIIIAAHN
ref|YP_516465.1|       --------------VQLIIIFMTFYYFVLSMFG--LFRRPDK-KVLEPEKSFALVVAAHN
ref|YP_001211020.1|    --------EAIFYATQVFLTLFTFYHFIISLYG--FYRRHEE-CLLPPSSRFAIVVAAHN
RAAC01926              MTLMYLLWDTFYDALKLVTGLVALYQIVLSVYG--IWHRRRP-ITHAPQKRFAIIIPAHN
                                         ::.    :   *  :::::*   .  :*         *  . ::: .* ref|YP_001038202.1|    EEAVIGHIVDSLFRQNYPRNLFDVYVVADNCTDRTAEIAEEHGAIVYKRYNNSARGKGYA
ref|ZP_01575301.1|     EELVIGHIVDSLFKLNYPKNLYDVFVIADNCTDNTAGIARRFGAKVHIREDASKKGKGHA
ref|ZP_01667587.1|     EEQVIGQLVENLQVLRYPRELYDIFVVADNCKDRTAQIARNAGAIVYERFNLEQRGKGYA
ref|YP_516465.1|       EEAVIGPLVDNLLNLDYPKELYDVFVVADNCTDKTALIAKNAGALVHQRFNNEKRGKGYA
ref|YP_001211020.1|    EEKVIGELIRNLNELDYPKELYDVYVVADNCTDSTAKIAREKGAVVFERFNKAERGKPYA
RAAC01926              EECVIGPLLDSLKRQTYPAHLYDVHVIADNCTDGTAERARAHGAIVHVRENRAEQGKGYA
                        *  ::  .*       ** .*:*:.*:**** * **  *.  ** *. *  :       :**  :* ref|YP_001038202.1|    LEWMFEKIYNMEEKYDAISVFDADNLVSANYLLEMNKQLCKGHKVVQGYVDSKNPFDSWI
ref|ZP_01575301.1|     LEWMFHRIFHMDTSYDAIAVFDADNLVSQNFLLEMNKQMCKGFKVVQGYIDSKNPYDSWI
ref|ZP_01667587.1|     MEWMFAKLFRMKRKYDAVVVFDADNLVHPNFLLEMNNRLCKGEKVIQGYLDAKNPHDTWI
ref|YP_516465.1|       LEWMFHRLFKLERHYDAVIIFDADNLVNETFLVEMNSKLCQGHQIVQCYLDSKNPYDTWV
ref|YP_001211020.1|    LEFAFSKIFESGIPYDAVCVFDADNLVDTNFLTVMNAHLLKGEKIIQGYLDTKNAGDTWI
RAAC01926              IEWMLARLKEMGARYDAIVMFDADNLVHPDFLAIMNDHLCSGDRVIQGYLDTKNPFDSWI
                       :*:    :  ::      .    ***:*******      :*     **    ::   .*    ::*  *:*:**. *:*:

ref|YP_001038202.1|    TLSYSIAFWLSNRIFQLPRYYLG-LSCGLCGTGFCISVDVLKEIGWGATCLTEDLEFTMK
ref|ZP_01575301.1|     TCSYSIAFWLSNRIYQLPRYYLK-LSCGLCGTGFCIDTSILKTLKWGATCLTEDLEYTMK
ref|ZP_01667587.1|     AGTFAISFWVVNHIWHLAKYNIG-LSSVLGGTGMCIATDVLQKFGWGATCLTEDMEFTMK
ref|YP_516465.1|       TNTFSITFWLSNRLLQLARYNTGFLNNVLGGTGMCISTKVLKDLGWGATSLTEDLEFTMK
ref|YP_001211020.1|    TKSIYVSYILTNRFLQLSKYNLG-LTCALGGTGMCLSVDVLKRYGWGMTSLTEDLEFQTK
RAAC01926              SVSLAISYWFDNRLWQYARARLH-LPCTLGGTGLCIDYPLLQEMGWKATGLTEDLEFGIR
                       :  :   :::  .  *:: :  .:          *      * ***:*:     :*:      *     * ****:*:   :

ref|YP_001038202.1|    LALNNYKVAWAHNAVVYDEKPITLKQSWNQRKRWMQGHADCASRYLGPLFKKAFREGDLI
ref|ZP_01575301.1|     MALNGVKIGWAHEAVVYDEKPITLKQSWHQRKRWMQGHAECAQKYLGALFKKALFKGDLT
ref|ZP_01667587.1|     VLLKGIRTTWAHDAIVYDEKPLTFKQSWYQRKRWAQGHFDVAGRYIPRLLYEGFKRRDIR
ref|YP_516465.1|       ALISGIKTTWAHDAIVYDEKPLTFIQAWNQRKRWAGQVDVAGRYFFPLIYKAFKERKLM
ref|YP_001211020.1|    ALLNGIKVTWAHDARVYDEKPLTLMQSWRQRKRWMQGHTNVAGRYVARLVREGIRTRNFA
RAAC01926              CVRRGIIPVWAHDARVYDEKPTSFAASFRQRLRWQQGHFQCAREHLVPMFLEGLRERNLA
                          .         ***:* ****** ::       ::  ** ** **:  :  *   .:.   *    :. .:.     .:

ref|YP_001038202.1|    AFDCAVYLFQPIR--LVFIG-LITIM-MWIQTVFPESPFYNLKY--------VFPTEVWS
ref|ZP_01575301.1|     SLDCALYLFQPIR--FIFVG-LMTVM-MWVQTVYPQFPLYSVQY--------VFPVQVWY
ref|ZP_01667587.1|     ILDGVLHLLQP---HFLIL----STIFVLLSYIYHIVPFYTNIL------YMVLPVEVWT
ref|YP_516465.1|       YFDAAVHLFQP---ALVMI----ATFFMFVNLISGLQSSYTQVFN------VVMPWSGWQ
ref|YP_001211020.1|    MIDGAVYLIQPY----------FLMFTGIGLITNI-FMGPD---------QILDRPVWL
RAAC01926              KIDMAIYLFQPMRSMLLFAG---AMIVLGLHYLSPDPTDAASNP------AALMVTNLWV
                       :*  .::*:**          :      :        * ref|YP_001038202.1|    VFVTLQFLYGPLVVLSEKKFNLKVLYGFLIYPFYCITWIPITIQGFMSKNNKDWSHTQHS
ref|ZP_01575301.1|     LMGLFEMFYGPLVILAEKKFSLKVILGFIIYPYYCLTWIPITIQGILEKNNKEWNHTVHT
ref|ZP_01667587.1|     VIAIGQYVFPI-IVLAKIRAHWKSWLYLIFYPIFVYSWIPITFMGYLHRNDREWSHTQHT
ref|YP_516465.1|       ILSAFSLVFPV-AALALERLPWRAYAGLILYPVFIYSWIPIVFLGFVNRKDKSWSHTKHT
ref|YP_001211020.1|    VVGFFAQFFYFGLGLALERVKPVVYWWLIFYPIFALTWIPVAYVGFAMRKNKEWTHTLHF
RAAC01926              AVNVILFLEVP-LALLLERVNWRAYFALPLLPFFLWTGPVTLQAYFTRSNRTWYHTVHK
                           .    .    *   :         :  : *  :     :* *:.   .   :.::  *  ** *
```

FIG. 14B

```
ref|YP_001038202.1|    RKISISDLEK-
ref|ZP_01575301.1|     RQISINEL---
ref|ZP_01667587.1|     RGLSYHDI---
ref|YP_516465.1|       RSIKYDDV---
ref|YP_001211020.1|    RNIKHENL---
RAAC01926              RAIRLDELRER
                       *  :   : :
```

FIG. 15

```
ref|NP_348940.1|      ----------------------------------------MKIAVLIPCYNEELTIKKVITDF
ref|YP_015329.1|      ----------------------------------------KVAVLLPCYNEELTIGKVIDDF
ref|NP_721244.1|      ----------------------------------------MTEKIAILLPAYNEEITIQKVISDF
dbj|BAC75700.1|       ----------------------------------------MTEKIAVLLPAYNEEITIERVIKDF
ref|ZP_00605123.1|    -----------------------------------------KIAVLIPCYNEEATISTVIADF
RAAC01998             ---------------------------------------MTMRIAVLIPCYNEELTIGKVVQDF
                                                              : *:*:* **** ** *: **

ref|NP_348940.1|      KKVLPDAYIYVYDNNSKDNTAAIAKESGAIVVREPRQGKGNVVRSMFKDIDADYYIMVDG
ref|YP_015329.1|      KKELPNADIYVYDNNSKDKTFEIAKDHGAIVRKEMRQGKGNVVRSMFADIDADYYLMVDG
ref|NP_721244.1|      KRVLPEADIYVYDNNSKDRTNELARQAGAIVRFESRQGKGNVVRSMFREINADYYIMVDA
dbj|BAC75700.1|       QNVLPNADIYVYDNNSKDRTNELAKQSGAIVRFEPRQGKGNVVRSMFREIEADYYIMVDA
ref|ZP_00605123.1|    KRELPEADIYVYDNNSTDRTYELAVQGGAIVKKEPRQGKGNVIRQMFFDIDADYYLMVDG
RAAC01998             RRELPDAEIYVYDNNSRDRTAEVAREAGAIVRRETRQGKGNVVRSMFRDIDADVYVMTDG
                      :. **:* ********  *.*   :*  : ****  * *******:*.** :*:** *:*.*.

ref|NP_348940.1|      DDTYPAEFAKELLKPIINGEADMTIGDRLSNGTYESENKRAFHNFGNKLVKNLIGKLFKN
ref|YP_015329.1|      DDTYPAEYCHEILEVLRNKEANMVIGDRLSNGTYTEENKRNPHDFGNSLVRNTINRIFKS
ref|NP_721244.1|      DDTYPADEVQKLLDPLRSGKADMTIGDRLSNGTYAEENKRGFHGFGNNLVRLLVNHLYQG
dbj|BAC75700.1|       DDTYPAAEVNKLLEPLKNGMADMTIGDRLSNGTYSQENKRGFHDFGNNLVKYLINKLYQG
ref|ZP_00605123.1|    DDTYPAEAVHGLLEKLRSGEADMVIGDRLSNGTYFDENKRPFHDFGNNLVRNTITRMYKT
RAAC01998             DDTYPAEFVHDLIRPIIEGEADMCIGDRHSDGSYSKENKRPFHNFGNQLVRKLINTLFHA
                      ******    : ::    :  . *:*  **** *:*:* .**** **.***.**:   : :::

ref|NP_348940.1|      DINDIMTGYRAFNRYFVKTIPVLSSGFEIETEMSIHALDKKFLLKEIPIDYRDRPEGSSS
ref|YP_015329.1|      NLRDIMTGYRGFDRYFVKTMPVLSPGFEIETEMSIHALENRFLVKEIEIDYRDRPEGSES
ref|NP_721244.1|      NYQDIMTGYRGFNRLFVKNFPVLSSGFEIETELSIHSLDKRFKLVEVPITYHDRPEGSES
dbj|BAC75700.1|       HYNDIMTGYRGFNRLFVKNFPVISPGFEIETEMSIHALDKRFKLVEVPITYKDRPEGSES
ref|ZP_00605123.1|    KILDVMTGYRGFNRIFVKSFPIMSSGFQIETELTIHALDKKFKFVEIPIDYRDRPEGSES
RAAC01998             DLRDIMTGYRAFSRRFAKTMPIQSEGFEIETEMTLHALDKRFRILEIPIQYRDRPPGSHS
                      .  *:***** .*.*  *.*..:*:  * :**:::*:*::.*  .  *:  * *:*  * ref|NP_348940.1|      KLNTYKDGLKVIKTILFLFKDYKPLPFFSILALLIFPLIGLLVGSPVIIEFVKTHRISKLP
ref|YP_015329.1|      KLNTFSDGFKVIMTIVRLFKNSRPFLFFNLLASLFVLVGVLVGLPVIIQFAQIGLVLKFP
ref|NP_721244.1|      KLNTFSDGFKVLCMIFNLFKDYKPLIFFSLVTLFFFILGLIVGVPVVTEFAETGFIAKMP
dbj|BAC75700.1|       KLNTFSDGFKVLKMIFNLFKDYKPLIFFSLLTVVMFILGLIIGIPVITEFAKTGMIDKLP
ref|ZP_00605123.1|    KLNTFSDGFKVIMMIIKMFKDYKPLLFFGIWTIFFFLFGLVTGIPVIREYMLTSFITRIP
RAAC01998             KLNTLSDGIRVLKTVFWIFKDYKPLAFFTAVALILFLAGLGVGIPVLYEYFSFGRIAKIP
                      **  .::*:   :.  :**: :*:  **   :  .:.: *:  * **:  ::    :  ::* ref|NP_348940.1|      SAVLTMGLITSAIMFFVNGLILDTLVKQNNQNYELFLNNYK-
ref|YP_015329.1|      SALLATGLIIMGMLFFICGLILDTIAHRSRQSYFL-------
ref|NP_721244.1|      SAILATGFMILAALSFALGFILDTIVRQNRMQYEL-------
dbj|BAC75700.1|       SAILATGFMILAALSFVSGFILDTVVRQNRMQYEL-------
ref|ZP_00605123.1|    SAILSTGLMTLALLSLVTGLILDTVVTNAKKEYEL-------
RAAC01998             SAILAVGFMVLATNSLTCGFILDTIVRHHRDYYELQNEFKG
                      **:*: *::   .   : *:****:.  .    *
```

FIG. 16

```
ref|NP_142068.1|    ------------------------VSIIVPTYNERDNLEELFSRISSALK--GYDYEI
ref|NP_125751.1|    --------------------ALIMKVSVIVPTYNERENLEELFSRIDKALKDY--DYEI
ref|NP_577787.1|    -------------------------VSVIIPTYNERENLEELFSRIDNALQ--GLNYEI
ref|YP_184322.1|    -------------------------ISVVIPTYNERENLPELVERLSRALQ--GYEYEI
ref|YP_754819.1|    -------------------------LSIIIPTYNERDNVLRIAEHIGNTLKN---SYEI
RAAC02011           MRGSAMMDRAKPRIGRPWRKEALCVDVSVVIPTYNERDNIHPLVERIHQALAPLGISYEI
                                             :*::*******:*:  : .::  :*   .*** ref|NP_142068.1|    IIVDDDSPDKTWEKAMELSKLYP-VKVIRRVNEKGLSSAVIRGFSEASGDVFVVMDADLQ
ref|NP_125751.1|    IVVDDDSPDETWKKAQELSSVYP-VKVIRRINEKGLSSAVIRGFKEASGDVFVVMDADLQ
ref|NP_577787.1|    VVVDDDSPDRTWEKAQELSSKYP-VKVIRRTKEKGLSSAVIRGFKEASGDVFVVMDADLQ
ref|YP_184322.1|    VIVDDDSPDKTWGLAEELARKYP-IKVIRRTKEKGLSSAVIRGFKEASGDVFVVMDADLQ
ref|YP_754819.1|    VFVDD-SNDDTPEILQYLSKSDPHLRFEHRHKERGLGTAVVRGFEIASGDVIAVMDADLQ
RAAC02011           WFVDD-SSDDTVAVLRDLEARDPAVHVFHRDHERGLASAVVRGFEKAQGRYLVVMDADLQ
                     .***  *  *         *       *  ::. :* :*:.::***.*.*  :.******* ref|NP_142068.1|    HPPEVIPSLLREIEKGNDIAIASRYVKGGKVENWPFYRRLISRGAIIIGRLALPKIAGIK
ref|NP_125751.1|    HPPEVIPELLKRIKEGADLAIASRYVKGGRVENWPLYRKLISKGAIMIARVALPKIRSIK
ref|NP_577787.1|    HPPEVIPKLIEAIKNGSDIAIGSRYVKGGKVENWPFYRKLISKGAIMVGRIALPKIRDIK
ref|YP_184322.1|    HPPEKVPELIEAIKRGADIAIASRYVPGGAVKNWYWYRKLISKGAIMIGRVALPRIRNVK
ref|YP_754819.1|    HPPEVLLSMLKAIESGADIVIPSRFIPGGNDGGLKLHRKIVSATARYIGKALIKKLRPIS
RAAC02011           HPPELLPAIYERLESGIDVVIPSRFVEGGSDGGLGPLRKLISWTARVIGQLALHRLRKIS
                    ****   :   : . .:  *  *:.*  **::   **       *:::*   *   :.:  : ::  :.

ref|NP_142068.1|    DPVSGFFALKRSVVEGVKLNPIGFKILMEILIKGKYSRVTEVPFTFSTRKFGESKLKGKT
ref|NP_125751.1|    DPVSGFFALKRNVVDNVNLNPIGFKILLEILIKGRYSRVEEVPFTFGTRLSGESKLKGKT
ref|NP_577787.1|    DPVSGFFALRKEVVEGVELNPIGFKILMEILIKGKYSKVVEVPFTFGIRARGESKLKGKT
ref|YP_184322.1|    DPVSGFFALRREVVEGVELNPVGFKILMEILVKGHYNNVREVPFTFGLRKAGESKLGSRT
ref|YP_754819.1|    DSTSGFFMFRKDVIKEAELQPIGWKILIEVLARGKYTRVIEIPYQFQARTAGESKMSAQE
RAAC02011           DCTSGFFGLRREVIEGVELNPIGWKILIEVLVKGRYRSVHEIAYEFVARDFGESKMSLKE
                    *  .****  :::.*:. ..:*:*:*:***:*:* :*:* *  *:.: *  *   ****:  :

ref|NP_142068.1|    MVNYLRHVYRLMKWEGEVDRILKFSIVGLSGVGVNEGFL-WLFVNFFHISKELGVIPSTE
ref|NP_125751.1|    MLNYLRHVYRLMKWEGEIDRLVKFSIVGLSGVAVNEGFL-WLFVKMG-IRKEVAVLPSTE
ref|NP_577787.1|    IFEYLRHIYRLMKWEGEIDRIVKFSIVGLSGILVNEGFL-WLFVNLG-IPKEIAVIPAVE
ref|YP_184322.1|    IVNYLRHIYRLMRWEGEIDRLVKFSLVGLSGVLVNEGFL-WAFVEFFGWDKVFSNILATE
ref|YP_754819.1|    QWNYIRHLMRLVKDSPEDRRFFYFSLVGLSGVFVNMLIY-FFLTM-LNLEVRIAGFCSAF
RAAC02011           QWNYFRHLVRLVSQSPPDRRFFLFCLIGLSGVVVNEAVL-SLLWYGFHLRDTVASVAASF
                     :*:**: **:    .    *:.   *:::****: **   .     :      .. .:

ref|NP_142068.1|    LSILNNFLWNDLWTFK-DIKKGSVIE-RLAKFHVAAFVGAVAQFLVY----WILLFLGIH
ref|NP_125751.1|    LSVINNFIWNDLWTFK-DLRKGSVLR-RFFQFHIAALIGVFAQLLIY----WALLFLGVH
ref|NP_577787.1|    LSILNNFFWNDIWTFK-DIRRGSIFS-RLLKFHIAALSGAVVNFIVY----WILLFLGIH
ref|YP_184322.1|    LAILNNFTWNDIWTFR-DLKNKPLLK-RLVSFHVAALSGALVQWAIY----VILMAVGVH
ref|YP_754819.1|    VAMLVNFVLNDKITWA-YVKTNSVWS-RGSKYIITSLIGIGINVGVL---DFFYYQLQFN
RAAC02011           VAMLNNYFWNDRVTWK-SESSGRGWGWKLPVFVGISVVGIAITTLVMRG----CEGFGVP
                    ::::  *:   **  *:         :     :  .   *      :       . .

ref|NP_142068.1|    YLLANLFGIGASFVVRYIFNRHITW-----------------------------
ref|NP_125751.1|    YLISNLVGIGASFIVRYIFNRHVTW-----------------------------
ref|NP_577787.1|    YLIANLVGIVLSFGVRYVINRHVTW-----------------------------
ref|YP_184322.1|    YLLANLIGIVVSFIVRFAVNRHVTW-----------------------------
ref|YP_754819.1|    HLLSNLIGISCAVFWNYTINNLWTWST----AKHNNTIIERWTVQNGCESSVEKTGS
RAAC02011           VPAGQAIGILVSTAWSYWMNSRVTWRNIEREARGDAIVVTRESVRDSLMR--AKTGA
                                .:  .** :   :  .*   **
```

FIG. 17A

```
ref|NP_470039.1|      ------LISICMIVKNEAHILRQSLASFRKFTEEIIIVDTGSTDDTKEIAKEFTDFVYDF
ref|ZP_01929325.1|    ------LISICMIVKNEAHILRQSLASFRKFTEEIIIVDTGSTDETKEIAQEFTDFVYDF
ref|YP_848858.1|      ------LISICMIVKNEAHILRQSLASFRKFTEEIIIVDTGSTDETKEIAKEFTDFVYDF
ref|YP_001374688.1|   -------ISACLIVKNEEDMLRKCLESLQGGVDEIVVVDTGSTDTTKEIAKEFTDKVYDF
ref|NP_622177.1|      -------LSLCLITKNEEKNISRCINSVKDIVDEIVVVDTGSTDRTIEIAKSFGAKVIQI
RAAC02381             MRRIVVLLSACLIVKNEAHVLPRCLGSLQGVADEIVVVDTGSTDDPRIAESFGARVYHF
                            :* *:*.***  .  : :.: *.:  ..:**:.******* * .**:.*   *  .:

ref|NP_470039.1|      EWTGNFSDARNFAAKHATGKWILAIDADECLEEESYRKLEKQLKSPIEP--IQMAQIISF
ref|ZP_01929325.1|    EWTGNFSDARNFAAKHATGKWILAIDADECLEEESYRKLEKQLKSPTEP--IQMAQIISF
ref|YP_848858.1|      EWTGNFSDARNFAAKHATGKWILAIDADECLEEESYLQLKKQLKAPTEP--IQMAQIISF
ref|YP_001374688.1|   EWTNDFAEARNFAASKASGEWILAIDADECVDPKNLAAAIEEIQSHDNKFDVYAVEINSF
ref|NP_622177.1|      KWEDDFSKARNTAIESATGDWILFLDADEEIKKEDVSKIKSLLYDDTVEAYLFKFVNYAG
RAAC02381             EWTGDFAVARNESLRYALGEYVLVIDADEFLPKEDGVRLRQALQERRADAYTVDLVNYLG
                      :*  .:*: ***   :    * *.::*  :****  :     :.         . :

ref|NP_470039.1|      TGEKGRVTTTNQMARVYKNDGTICFRGVIHEQ-----LEAVDKHAIEAGLAEVKIYHYGY
ref|ZP_01929325.1|    TGEKGRVTTTNQMARVYKNDGTICFRGVIHEQ-----LEAIDKRPIAAGVAEVKIYHYGY
ref|YP_848858.1|      TGEKGRVTTTNQMARVYKNDGTICFRGVIHEQ-----LEGIDKHAVETGFAPVKIYHYGY
ref|YP_001374688.1|   SDKYGENLSMNHMQRIYKNNGEFHFSGAIHEQI----VEKGEGR-QELVFSALKLYHYGY
ref|NP_622177.1|      SSINSGLTEINYNYRLFRNNGKLKYIYPVHEN----LRNIEENRPPIAKKADVTILHYGY
RAAC02381             SVARFVRSPGVRVVRVFRRG--FSYMGSIHEQ----ILYDVIAKGGQIEVLDVEIHHLGY
                      :           *:::..    :  :  :**:           :            : : * ** ref|NP_470039.1|      MSEIVEKQDKSDRNLRLLEKEVKNNKNSGFVHFNIGQEMNRLGNKKEALKEFSEAFRL--
ref|ZP_01929325.1|    MSEIVEKQDKSDRNLRLLEKEVKNNKNSGFVHFNIGQEMNRLGNKKEALKEFSEAFRL--
ref|YP_848858.1|      MSEIVEKQGKSDRNLRLLEKEVKNNKNSGFVHFNIGQEMNRLGDKKEALKEFTKAFRL--
ref|YP_001374688.1|   LPNVVKKKNKRKRNMDILKKALKSNNNDGFTYFNYGQELRSLGKTKEALESFIKAY----
ref|NP_622177.1|      LADIRKEKNKSERYIKLISKYLESHPEDKFQHANLAVEYFNIGDYQKALKHLLIATKGMD
RAAC02381             LAEFVALKGKSDRNLEILNQALAIDPDNFFHITNLMAEYARLGDPKKVVELGERAYDLFQ
                      :.:.      :.*  .*  :  :::.:  :     . :.  *     *       :*.  ::.::    * ref|NP_470039.1|      --RDNNHYIWAKLSAYHISELLEQE-KRYDESLAIIEEAKVIWPNVPEFPLKKANILYVN
ref|ZP_01929325.1|    --RDHNHYIWAKLSAYHIAELLEQE-KRYDESLAIIEEARVIWPNVPEFPLKKANILYVN
ref|YP_848858.1|      --RDNNQYIWAKLSAYHISELLEQE-KRYEESLAIIEEAKVIWPNVPEFPLKKANILYLH
ref|YP_001374688.1    QNKEDVYEEWVSRCLYFIVEMLVEL-KRYEEAIVIINDAEEVFSTAPDFPFWKGEIYFKQ
ref|NP_622177.1|      VNSVN----ATRLLRYLIGCYIGLK--DYSTALKIIKDAKDYYKDIPDFSFLEGLMYMDQ
RAAC02381             RGRVNQPHLVLRMYRMMIAAHGDLG--NYDRVEALAREAELFFPNIPDVPFVHALYVMQR
                           .          *   *.     :  ..:*.  :   *:...  ..             .

ref|NP_470039.1|      HQLEDAKEI---YKSLLENTAIDYQPI-VLYEATNFMPHKMLGTIYLEEKDYTRAMTHFS
ref|ZP_01929325.1|    HQLEDAKEI---YQSLLENAAIDYQPI-VLYEATNFMPHKMLGTIYLEEKDYTRAMTHFS
ref|YP_848858.1|      HQLEDAKEI---YHSLLDNKVIDYQPI-VLYEATNFMPHKMLGTIYLEEKDYTRAMTHFS
ref|YP_001374688.1    KRFDDAKEV---YTHIISNNMIYQNAVFN-AGAKTFLPHVRLGEIYTQERQHQQALQHYV
ref|NP_622177.1|      KRYEKAIEA---FKESLSIGEYDGLFI-TMGGTGSYRARYMIGLCKEKLNQLNDAVKEYI
RAAC02381             GDWRKAIRL---FERSREIGEIRSEIIDTIAGAGSYVAAAKLGELWLLEGDVELAREYFV
                       .*  .    :     .     :      : .: .    :*    :    *    :

ref|NP_470039.1|      KAYAENSSDYGVMFQMIMLL----------------------------------------
ref|ZP_01929325.1|    KAYAENSSDYGVMFQMIMLL----------------------------------------
ref|YP_848858.1|      KAYAENSSDYGVMFQMIMLL----------------------------------------
ref|YP_001374688.1|   EALNEN------------------------------------------------------
ref|NP_622177.1|      EVLKENPNYQEVFIKLFDLFIKNEP-----------------------------------
RAAC02381             QSLRENLRQEGTFFFLASLLPLNDPSVFEQLRALASHDPVCLAYLALAGAVWRVDHAWRL
                      :   **
```

FIG. 17B

```
ref|NP_470039.1|      ----------------------------------------------------
ref|ZP_01929325.1|    ----------------------------------------------------
ref|YP_848858.1|      ----------------------------------------------------
ref|YP_001374688.1|   ----------------------------------------------------
ref|NP_622177.1|      ----------------------------------------------------
RAAC02381             INEIEQTPVTAPIVAKLRALGAVLGILPANDVRVDSTVEREIQWYEALFALERGDRDQAE ref|NP_470039.1|      ----------------------------------------------------
ref|ZP_01929325.1|    ----------------------------------------------------
ref|YP_848858.1|      ----------------------------------------------------
ref|YP_001374688.1|   ----------------------------------------------------
ref|NP_622177.1|      ----------------------------------------------------
RAAC02381             RCLRDQPERWERLSEWLTSKQGLCISPILDELLLARVDELLLAWLPRAEDRDLALSRVLA ref|NP_470039.1|      ----------------------------------------------------
ref|ZP_01929325.1|    ----------------------------------------------------
ref|YP_848858.1|      ----------------------------------------------------
ref|YP_001374688.1|   ----------------------------------------------------
ref|NP_622177.1|      ----------------------------------------------------
RAAC02381             SPLREEVWKAAWLGERGWECDFLALGAFRRRDIQASLNWLERGLTYEPTVRRAIVEIDLA ref|NP_470039.1|      ----------------------------------------------------
ref|ZP_01929325.1|    ----------------------------------------------------
ref|YP_848858.1|      ----------------------------------------------------
ref|YP_001374688.1|   ----------------------------------------------------
ref|NP_622177.1|      ----------------------------------------------------
RAAC02381             LCHKNIAHAQEVASQASRLFPESKLLEGIAGSLGVSPRPMRSLDDLLGGGSGLNPHRAYQ ref|NP_470039.1|      ----------------------------------------------------
ref|ZP_01929325.1|    ----------------------------------------------------
ref|YP_848858.1|      ----------------------------------------------------
ref|YP_001374688.1|   ----------------------------------------------------
ref|NP_622177.1|      ----------------------------------------------------
RAAC02381             SSVNSMPLKVKIMKLHERAVECVDQVKALVDQGDIMGARTYIQYVQDIITFLRSNLDTST ref|NP_470039.1|      ----------------------------------------------------
ref|ZP_01929325.1|    ----------------------------------------------------
ref|YP_848858.1|      ----------------------------------------------------
ref|YP_001374688.1|   ----------------------------------------------------
ref|NP_622177.1|      ----------------------------------------------------
RAAC02381             EAGKAADAAYAYFYKMLVEWFLQPSKVESEYKEMRDFWQSWADTWAKVEA
```

FIG. 18

```
ref|YP_001486101.1|    --QFIVSQEDWSLHRKGYDDQQRHQKKVKEAIKNNLPDLVTEESIIMSNGKDVVKIPIRS
ref|ZP_01170532.1|     --QFVISEEDWSLHRKGHDDQQRHQEKVQDAIRNNLPDLITEESIIMSNGREVVKIPIRS
ref|NP_241897.1|       ---FVVSQENWTLHRKGYQDQRRHQEKVKEAIRKNLPDLVSEENIIMSNGREVIKIPIRS
ref|ZP_01721811.1|     ---FVISQENWSLHRKGHQDQQRHMEKVKDAIKNNLPDLVSEESIVMSNGREVIKIPIRS
ref|ZP_02327994.1|     ---FIVSRENWSLHRKGYQDQTRHQQKIKDAIKQNLPDLVTEENIILSNGKQIIKIPIRS
RAAC02421              MVEFTLQREDWSLHRKGHIDQERHREKVREAIREHLADLVSDESLIMSDGKQIIKIPIRS
                         *  ..*:*:***:   **  :*::**:::*.**:::*.:::*:*:::****** ref|YP_001486101.1|    LDEYKIRYNYDKNKHVGQGDGDSEVGDIVARDG--SDSKQGQGKGQSAGDQAGE--DYYE
ref|ZP_01170532.1|     LDEYKIRYNYDKNKHVGQGDGDSQVGDVVARDG--SSGQKGPGKGQGAGDQPGE--DYFE
ref|NP_241897.1|       LDEYKIRYNYDKNKHVGQGDGDSQVGDVIARDP--SAGQQGPGKGQGAGDQPGE--DYFE
ref|ZP_01721811.1|     LDEFKIRYNYDNSKHVGQGDGDSNVGDVVARDG--SKANQTQGKGKEAGDKPGQ--DYYE
ref|ZP_02327994.1|     LDEYRFRFNYNKSKHVGQGDGDSQVGDVLG-----IDPYTQQGKGAGAGDQAGE--DYYE
RAAC02421              LEEYRIRYNFQKGKHVGSGSGDTAVGDLVARGKPDADGQPGPGQGEGAGSEPGV--DYAE
                       *:*::::*:*::*.****.*.: *::.        *.*  **..*    ** * ref|YP_001486101.1|    AEVSLMDLEEALFRELELPNLKQKELDDIIVEQIEFNDIRKTGLTGNIHKKRTMLSAFKR
ref|ZP_01170532.1|     AEVSMMELEEEALFKQLELPNLKRKEQEEHLVENIEFNDIRKTGLMGNIDKKRTMMTAFKR
ref|NP_241897.1|       AEVSILELEELLFREHLELPNLQQKEEDHLVVEHIEFNDIRKKGLMGNIDKRRTILSAIKR
ref|ZP_01721811.1|     AEVSLEEIQNVLFHELELPNLQQKEKAEIVTEKIEFNDIRKKGLMGNVDKKRTILNALKR
ref|ZP_02327994.1|     AEVDMEELQSLLFEELELPYLNPKERLDISTQDIIFNDIRKKGIMSNIDKKRTILENIRR
RAAC02421              AEVTLEDIQQELFRELELPDLAEKDEADMVVDTVEFRDVRKKGITANIDKKRTLLQALRH
                       ***  :  :::.  **.:****  *:      .:  : *.*:**.*:  .*:.:**::   :::

ref|YP_001486101.1|    NAMTGSPSFYPIYPEDIKYKTWNEVTKPESKAVVLAMMDTSGSMGLWEKYMARSFFFWMT
ref|ZP_01170532.1|     NAMTGKPAFYPIYQEDLKFKTWNEIVKPDSKAVVLAMMDTSGSMGLWEKYMARSFFFWMT
ref|NP_241897.1|       NALEGRPGLIPIYNDDLRFKTWNEVVRPESKAVVLAMMDTSGSMGRWEKYMARSFFFWMT
ref|ZP_01721811.1|     NAMHGKAEITPIHNDDLRFKIWDEVVKPESKAVVLAMMDTSGSMGAFEKYCARSFFFWMT
ref|ZP_02327994.1|     NASSGTPGIHGISPDDLRFKTWDEIEKPHSNALILAMMDTSGSMGSFEKYIARSFFFWMT
RAAC02421              AKKDDR---VVITPDDLRYKTWETIVKPDSNAVILAMMDLSGSMGLFEKYCARTFFFWMT
                                .   *  :*:::* *:  : *.*:*::*** * :* :*** ref|YP_001486101.1|    RFLRTKYETVDIEFIAHHTEAKVVDEEHFFSRGESGGTICSSVYRKALELIDERYPPSRY
ref|ZP_01170532.1|     RFLRTKYETVEIEFIAHHTEAKVVSEEDFFSKGESGGTICSSAYRKALELINEKYNPRRF
ref|NP_241897.1|       RFLRTKYETVDIEFIAHHTEAKVVSEEDFFSKGESGGTICSSAYRKALELINEKYDPARY
ref|ZP_01721811.1|     KFLRSKYETVEIEFIAHHTEAKVVTEEEFFTKGESGGTICSSAYKKALELIKEKYSPSRY
ref|ZP_02327994.1|     RFLRSKYEHVDIVFIAHHTEARIVSEEEFFTKGESGGTICSSAYQAALDVIDRSYPPSKY
RAAC02421              RFLRTKYANVQIRYIAHHTEAHEVDEEYFFTKGESGGTICSSAYQYALDMVNREYPPERY
                       :***:**  *:*  :*******: * ** **::**********.*: **::..  * ::

ref|YP_001486101.1|    NIYPFHFSDGDNLTSDNARCVKLVSEIMKKANLFCYGEVNQYNRHSTLMSAYKHIQDEKF
ref|ZP_01170532.1|     NIYPFHFSDGDNLTSDNARCVKLVEELIAVSSMFGYGEVNQYNRHSTLMSAYKNIKNEHF
ref|NP_241897.1|       NIYPFHFSDGDNLTSDNARCLKLVHELMESSSMFGYGEVNQYSRHSTLMNAYKNLKDPRF
ref|ZP_01721811.1|     NIYPVHFSDGENISMDNEKCLKLVAELMDVSSMFGYGEVNQHNRFSTLMYTYKKIDDPKF
ref|ZP_02327994.1|     NIYPFHFSDGDNLTSDNERCVKLIQRLMERSNMFGYGEVNQYNRSSTLMQTYRHIQDPKF
RAAC02421              NIYSIHFSDGDNLTSDNEKCVQLVKELSSVSRMFGYAEVNQYSRSSTLMSAYGKLQIPRF
                       *..****:*:: **  *:::*:  .:    : *.****:.* **** .*  :: :* ref|YP_001486101.1|    KHYILKQKSDVFLALKKFFQQEE-----
ref|ZP_01170532.1|     RYYILKQKADVFHAMKSFFQNEE-----
ref|NP_241897.1|       RSYVLKEKGDVYRAMKTFFKKEE-----
ref|ZP_01721811.1|     RHHILRKKGDVYDALKSFFKKNE-----
ref|ZP_02327994.1|     LYYIIREKGEVYKALKTFFAKPEG----
RAAC02421              RTYVIRDKSEIYGALRHFFSQQQGVKSA
                        :::.*.::: *::  ** :
```

ALTERATION AND MODULATION OF PROTEIN ACTIVITY BY VARYING POST-TRANSLATIONAL MODIFICATION

RELATED APPLICATIONS

This application is a continuation-in-part of pending application Ser. No. 12/380,450, filed Feb. 26, 2009. This application is also a continuation-in-part of U.S. patent application Ser. No. 11/266,063, filed Nov. 2, 2005, now U.S. Pat. No. 7,727,755, issued Jun. 1, 2010, the entirety of each of which is incorporated herein by this reference.

GOVERNMENT RIGHTS

This invention was made with government support under Contract Numbers DE-AC07-99ID13727 and DE-AC07-05ID14517 awarded by the United States Department of Energy. The government has certain rights in the invention.

STATEMENT ACCORDING TO 37 C.F.R. §1.52(e)(5)—SEQUENCE LISTING SUBMITTED ON COMPACT DISC

Pursuant to 37 C.F.R. §1.52(e)(1)(ii), a compact disc containing an electronic version of the Sequence Listing has been submitted concomitant with this application, the contents of which are hereby incorporated by reference. A second compact disc is submitted and is an identical copy of the first compact disc. The discs are labeled "copy 1" and "copy 2," respectively, and each disc contains one file entitled "Seq list BA 315.txt" which is 964 KB and created on Dec. 16, 2009.

TECHNICAL FIELD

The present invention relates generally to the field of biotechnology. More specifically, embodiments of the present invention relate to post-translational modification of proteins.

BACKGROUND

It has been believed until only very recently that bacteria in general do not glycosylate their proteins. While there have been some instances reported, these were dismissed as unusual anomalies (Borman 2006). It is now becoming more accepted that bacteria do glycosylate their proteins in perhaps more ways than eukaryotes do, although this belief is not yet widespread (Schäffer et al., 2001). In a recent review article, it was stated that glycosylation has been shown to assist in protein stability, modulate physical properties such as solubility, protect against proteolysis, modify activity profiles, and target for externalization (Upreti et al., 2003). In 1994, a group purified an amylase from *Alicyclobacillus acidocaldarius* and showed that the amylase was cell-bound during active growth (Schwermann et al., 1994). As the culture entered stationary phase, the cells released an active soluble glycosylated version of the amylase into the medium (Schwermann et al., 1994). No attempt was made to compare the activities of the various forms of the amylases.

BRIEF SUMMARY

Embodiments of the invention include methods of altering the enzymatic activity of an extremophilic enzyme or other protein via means of chemical glycosylation and/or isolated or partially purified glycosyltransferases and/or post-translational modification proteins, extracts of cells comprising glycosyltransferases and/or post-translational modification proteins, and/or in cells comprising one or more glycosyltransferases and/or post-translational modification proteins. Embodiments of the invention include methods of post-translationally modifying proteins. In some embodiments, the post-translational modification may occur using means of glycosylation (including chemical glycosylation), pegylation, phosphorylation, methylation or other forms of post-translational modification and/or be isolated or partially purified glycosyltransferases and/or post-translational modification proteins, extracts of cells comprising glycosyltransferases and/or post-translational modification proteins, and/or in cells comprising one or more glycosyltransferases and/or post-translational modification proteins. Embodiments of the invention include post-translationally modified proteins including, but not limited to, SEQ ID NOS:307 (celB), 331 (an Endoglucanase C), 333 (a Peptidoglycan N-acetylglucosamine deacetylase), 335 (a Beta-galactosidase), 337 (an arabinofuranosidase), and 338 (an alpha-xylosidase). Embodiments thus include glycosylated versions of the aforementioned proteins.

A first aspect of the present invention relates to an enzyme isolated from an extremophilic microbe that displays optimum enzymatic activity at a temperature of greater than about 80° C., and a pH of less than about 2.

Another aspect of the present invention relates to a hemicellulase that was derived from *Alicyclobacillus acidocaldarius* (ATCC 27009).

Another aspect of the present invention relates to an enzyme that is useful in the degradation of complex biomolecules.

Still further, another aspect of the present invention relates to an enzyme that may be useful in a simultaneous saccharification and fermentation process to convert a biomass sugar into an end product.

Yet another aspect of the present invention relates to a method for the treatment of a biomass that includes the steps of providing a source of a biomass having a biomass sugar; pretreating the biomass with a water-soluble hemicellulase derived from *Alicyclobacillus acidocaldarius* (ATCC 27009) to produce an end product.

Another aspect of the present invention relates to a method for the preparation of a hemicellulase that includes the steps of providing a source of *Alicyclobacillus acidocaldarius* (ATCC 27009); cultivating the *Alicyclobacillus acidocaldarius* (ATCC 27009) in a microbial nutrient medium having a supernatant; separating the cells of the *Alicyclobacillus acidocaldarius* from the nutrient medium supernatant; and recovering and purifying the hemicellulase derived from the *Alicyclobacillus acidocaldarius* (ATCC 27009) from the nutrient medium supernatant.

Moreover, another aspect of present invention relates to a method for hydrolyzing a polysaccharide that includes the steps of providing a water-soluble hemicellulase derived from a microbe; and conducting hydrolysis of a polysaccharide with the water-soluble hemicellulase at a pH of less than about 2.

These and other aspects of the present invention will be described in greater detail hereinafter.

BRIEF DESCRIPTION OF THE SEVERAL VIEWS OF THE DRAWINGS

FIG. 1 depicts a sequence alignment between SEQ ID NO:1 (RAAC00164) and ref|YP_001223775.1|, ref|YP_729290.1|, ref|ZP_01084440.1|, ref|ZP_01079150.1|, and ref|ZP_01471594.1| (SEQ ID NOS:3-7) respectively, which all have the function assigned to SEQ ID NO:1 in Table 1. Amino acids conserved among all sequences are indicted by a "*" and generally conserved amino acids are indicated by a ":".

FIG. 2 depicts a sequence alignment between SEQ ID NO:18 (RAAC00517) and ref|ZP_00589533.1|, ref|ZP_01386435.1|, ref|YP_378533.1|, ref|ZP_00513158.1|, and ref|YP_374173.1| (SEQ ID NOS:20-24) respectively, which all have the function assigned to SEQ ID NO:18 in Table 1. Amino acids conserved among all sequences are indicated by a "*" and generally conserved amino acids are indicated by a ":".

FIG. 3 depicts a sequence alignment between SEQ ID NO:35 (RAAC00650) and ref|YP_001127183.1|, ref|ZP_02038504.1|, ref|YP_001647987.1|, ref|YP_001377114.1|, and ref|NP_835081.1| (SEQ ID NOS:37-41) respectively, which all have the function assigned to SEQ ID NO:35 in Table 1. Amino acids conserved among all sequences are indicted by a "*" and generally conserved amino acids are indicated by a ":".

FIG. 4 depicts a sequence alignment between SEQ ID NO:52 (RAAC00991) and ref|ZP_02327412.1|, ref|YP_001487207.1|, ref|ZP_01172765.1|, ref|NP_831314.1|, and ref|NP_844008.1| (SEQ ID NOS:54-58) respectively, which all have the function assigned to SEQ ID NO:52 in Table 1. Amino acids conserved among all sequences are indicted by a "*" and generally conserved amino acids are indicated by a ":".

FIGS. 5A and 5B depict a sequence alignment between SEQ ID NO:69 (RAAC01110) and ref|YP_001519856.1|, ref|YP_711688.1|, ref|ZP_01331931.1|, ref|YP_001076955.1|, and ref|YP 336440.1| (SEQ ID NOS:71-75) respectively, which all have the function assigned to SEQ ID NO:69 in Table 1. Amino acids conserved among all sequences are indicted by a "*" and generally conserved amino acids are indicated by a ":".

FIGS. 6A and 6B depict a sequence alignment between SEQ ID NO:86 (RAAC01166) and gb|AAR99615.1|, gb|ABM68334.2|, ref|ZP_01372248.1|, ref|YP_519555.1|, and ref|ZP_02234077.1| (SEQ ID NOS:88-92) respectively, which all have the function assigned to SEQ ID NO:86 in Table 1. Amino acids conserved among all sequences are indicted by a "*" and generally conserved amino acids are indicated by a ":".

FIG. 7 depicts a sequence alignment between SEQ ID NO:103 (RAAC01167) and ref|ZP_01515212.1|, ref|YP_001277643.1|, ref|ZP_02291400.1|, ref|YP_001633727.1|, and ref|YP_001434357.1| (SEQ ID NOS:105-109) respectively, which all have the function assigned to SEQ ID NO:103 in Table 1. Amino acids conserved among all sequences are indicated by a "*" and generally conserved amino acids are indicated by a ":".

FIGS. 8A and 8B depict a sequence alignment between SEQ ID NO:120 (RAAC01170) and ref|YP_001324592.1|, ref|YP_342776.1|, ref|NP_780975.1|, ref|YP_001636830.1|, and ref|YP_001299026.1| (SEQ ID NOS:122-126) respectively, which all have the function assigned to SEQ ID NO:120 in Table 1. Amino acids conserved among all sequences are indicated by a "*" and generally conserved amino acids are indicated by a ":".

FIG. 9 depicts a sequence alignment between SEQ ID NO:137 (RAAC01248) and ref|ZP_02170160.1|, ref|ZP_01171895.1|, ref|YP_076646.1|, ref|YP_590910.1|, and ref|ZP_02175410.1| (SEQ ID NOS:139-143) respectively, which all have the function assigned to SEQ ID NO:137 in Table 1. Amino acids conserved among all sequences are indicted by a "*" and generally conserved amino acids are indicated by a ":".

FIGS. 10A and 10B depict a sequence alignment between SEQ ID NO:154 (RAAC01348) and ref|ZP_01665289.1|, ref|ZP_01643350.1|, gb|AAW77167.1|, ref|YP_452722.1|, and ref|ZP_02241787.1| (SEQ ID NOS:156-160) respectively, which all have the function assigned to SEQ ID NO:154 in Table 1. Amino acids conserved among all sequences are indicted by a "*" and generally conserved amino acids are indicated by a ":".

FIG. 11 depicts a sequence alignment between SEQ ID NO:171 (RAAC01377) and ref|YP_147952.1|, ref|YP_520670.1|, ref|YP_001395809.1|, ref|YP_001309701.1|, and ref|YP_001643660.1| (SEQ ID NOS:173-177) respectively, which all have the function assigned to SEQ ID NO:171 in Table 1. Amino acids conserved among all sequences are indicted by a "*" and generally conserved amino acids are indicated by a ":".

FIG. 12 depicts a sequence alignment between SEQ ID NO:188 (RAAC01611) and ref|YP_146214.1|, ref|YP_001124463.1|, ref|NP_865262.1|, ref|YP_426013.1|, and ref|ZP_01885526.1| (SEQ ID NOS:190-194) respectively, which all have the function assigned to SEQ ID NO:188 in Table 1. Amino acids conserved among all sequences are indicted by a "*" and generally conserved amino acids are indicated by a ":".

FIGS. 13A and 13B depict a sequence alignment between SEQ ID NO:205 (RAAC01612) and ref|YP_146215.1|, ref|YP_001124464.1|, ref|YP_074948.1|, ref|YP_001039503.1|, and ref|NP_621770.1| (SEQ ID NOS:207-211) respectively, which all have the function assigned to SEQ ID NO:205 in Table 1. Amino acids conserved among all sequences are indicted by a "*" and generally conserved amino acids are indicated by a ":".

FIGS. 14A and 14B depict a sequence alignment between SEQ ID NO:222 (RAAC01926) and ref|YP_001038202.1|, ref|ZP_01667587.1|, ref|ZP_01575301.1|, ref|YP_001211020.1|, and ref|Y_516465.1| (SEQ ID NOS:224-228) respectively, which all have the function assigned to SEQ ID NO:222 in Table 1. Amino acids conserved among all sequences are indicted by a "*" and generally conserved amino acids are indicated by a ":".

FIG. 15 depicts a sequence alignment between SEQ ID NO:239 (RAAC01998) and ref|NP_348940.1|, ref|NP_721244.1|, dbj|BAC75700.1|, ref|ZP_00605123.1|, and ref|YP_015329.1| (SEQ ID NOS:241-245) respectively, which all have the function assigned to SEQ ID NO:239 in Table 1. Amino acids conserved among all sequences are indicted by a "*" and generally conserved amino acids are indicated by a ":".

FIG. 16 depicts a sequence alignment between SEQ ID NO:256 (RAAC02011) and ref|YP_754819.1|, ref|YP_184322.1|, ref|NP_577787.1|, ref|NP_142068.1|, and ref|NP_125751.1| (SEQ ID NOS:258-262) respectively, which all have the function assigned to SEQ ID NO:256 in Table 1. Amino acids conserved among all sequences are indicted by a "*" and generally conserved amino acids are indicated by a ":".

FIGS. 17A and 17B depict a sequence alignment between SEQ ID NO:273 (RAAC02381) and ref|NP_622177.1|, ref|YP_848858.1|, ref|YP_001374688.1|, ref|NP_470039.1|, and ref|ZP_01929325.1| (SEQ ID NOS:275-279) respectively, which all have the function assigned to SEQ ID NO:273 in Table 1. Amino acids conserved among all sequences are indicted by a "*" and generally conserved amino acids are indicated by a ":".

FIG. 18 depicts a sequence alignment between SEQ ID NO:290 (RAAC02421) and ref|ZP_01721811.1|, ref|NP_241897.1|, ref|YP_001486101.1|, ref|ZP_01170532.1|, and ref|ZP_02327994.1| (SEQ ID NOS:292-296) respectively, which all have the function assigned to SEQ ID NO:290 in Table 1. Amino acids conserved among all sequences are indicted by a "*" and generally conserved amino acids are indicated by a ":".

DETAILED DESCRIPTION

Figure 19:
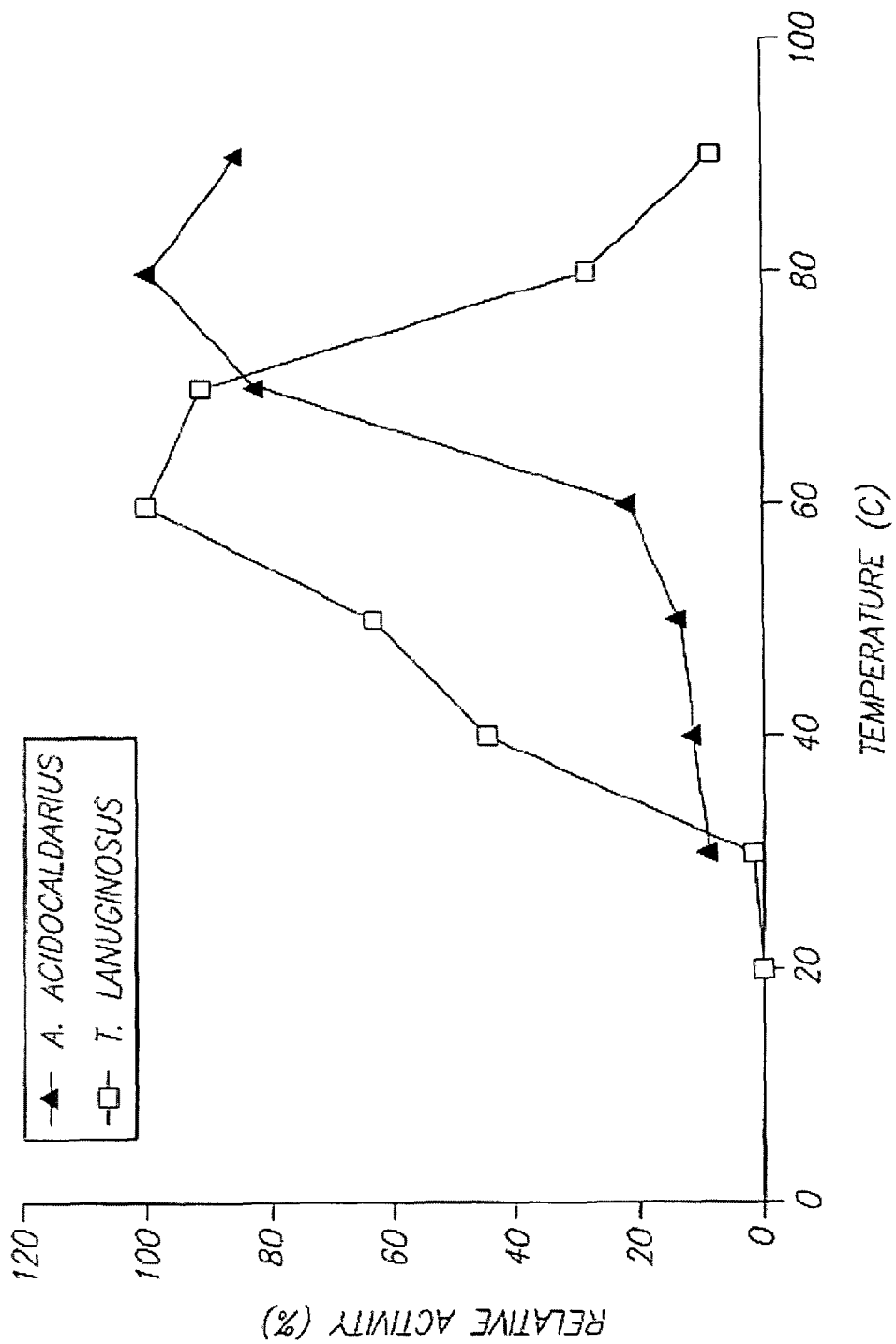
FIG. 19 is a graph depicting an effect of temperature on xylanase activity, as provided by the present invention.
Figure 20:
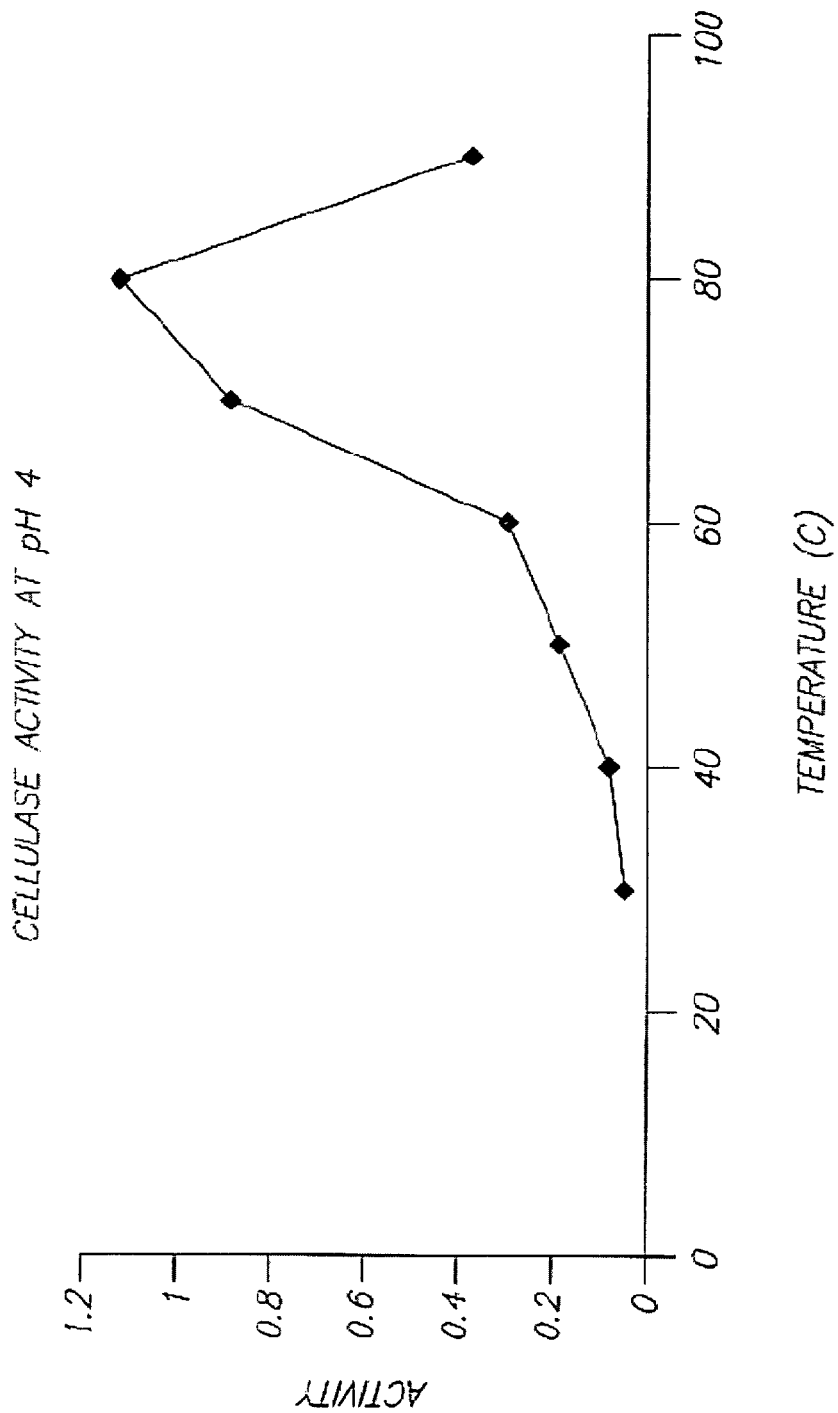
FIG. 20 is a graph depicting an effect of temperature on cellulase activity, as provided by the present invention at a pH of 4.0.
Figure 21:
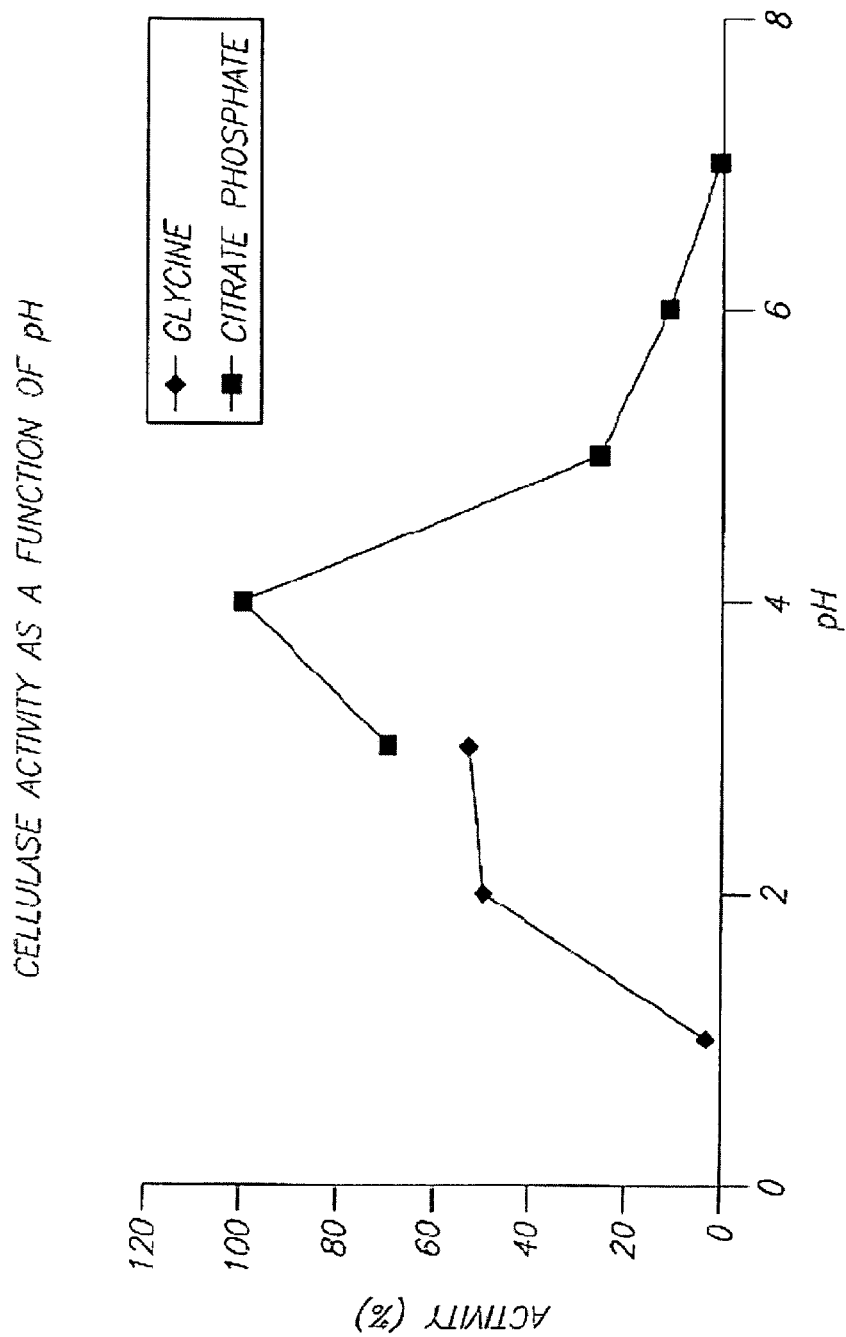
FIG. 21 is a graph depicting an effect of pH on cellulase activity of the present invention at a temperature of 60° C.

One aspect of the present invention, as described hereinafter, relates, in part, to enzymes isolated from an extremophilic microbe that display optimum enzymatic activity at a temperature of greater than about 80° C., and an optimum pH of less than about 2. In further aspects of the present invention, the enzyme may be a hemicellulase and/or xylanase that was derived from *Alicyclobacillus acidocaldarius*, where the organism is further identified as ATCC 27009. The enzyme, as discussed hereinafter, appears to display enzymatic activity at a pH of about 1. Still further, this same enzyme has a molecular weight of at least about 120 kDa. In the present invention, the enzyme, as disclosed, may be useful in a simultaneous saccharification and fermentation process and/or a sequential hydrolysis and fermentation process to convert a biomass sugar into an end product. Still further, the enzyme, as described herein, may be useful in the pretreatment of a biomass slurry to degrade a water-soluble or water-insoluble oligomer and/or polysaccharide that is present in the biomass slurry to produce an end product.

As used hereinafter, the term "extremophilic microbe" means an organism that can live and thrive under conditions that humans would consider extreme, such as boiling water, ice, battery acid or at the bottom of the ocean. Examples of such microbes include, but are not limited to, *Pyrolobus fumarii* that grows at temperatures up to 235° F. (113° C.), *Psychrobacter cryopegella* that survives at temperatures of −20° C. (−4° F.), *Deinococcus radiodurans* that can survive in a nuclear reactor, *Photobacterium profundum* that thrives at pressures 300 times the atmospheric pressure at sea level, and *Picrophilus torridus* that lives at a pH of 0, the same as battery acid. Environments in which these microbes can be found include boiling hot springs, deep ocean thermal vents, glaciers, salt flats, and nuclear reactors. The microbes used in the present invention can be obtained from natural and artificial sources or commercially from culture depositories. In the present invention, the cultivation is preferably conducted at temperatures above 40° C. and a pH below about 5, and more preferably above 50° C. and below a pH of 4, and most preferably above 55° C. and below a pH of 3.5, and under anaerobic, aerobic, and/or micro-aerophilic conditions. While the cultivation period varies depending upon the pH, temperature and nutrient medium used, a period of 12 hours to several days will generally give favorable results. As used herein, *Alicyclobacillus acidocaldarius* is defined as a microorganism that can be obtained from the American Type Culture Collection (ATCC), Manassas, Va., and that is identified as *Alicyclobacillus acidocaldarius* (ATCC 27009).

As used hereinafter, the phrase "enzymatic activity" means the reaction an enzyme causes to occur. Enzymes are proteins produced by all living organisms that mediate, cause and/or promote reactions that change a chemical into another type of chemical without themselves being altered or destroyed. In the context of the present application, the word "optimum," when used in combination with the term "enzymatic activity," means the most favorable conditions that allow the enzyme to work the best and the fastest for a given end result. The optimum enzymatic activity may be affected by conditions that include temperature, pH, and salt concentrations.

As used hereinafter, the word "xylanase" means an enzyme that breaks apart hemicellulose by breaking the chemical bonds between the xylose sugars that make up the backbone of the hemicellulose molecule, or by breaking bonds between xylose sugars in the hemicellulose side chains.

The word "polysaccharide" as used hereinafter shall mean a chain of sugars (can be the same sugars or different sugars) that are linked together by chemical bonds. Polysaccharides can consist of straight chains of these sugars with or without side chains. Examples of polysaccharides include starch, pectin, cellulose, and hemicellulose.

The word "hydrolysis" in the context of this present application shall mean a chemical reaction in which water reacts with a molecule and breaks it into at least two pieces.

As used hereinafter, the phrase "biomass sugar" shall mean sugars that have come from the breakdown of biomass components, such as cellulose and hemicellulose. Examples of biomass sugars include, but are not limited to, saccharides, glucose, xylose, galactose, mannose, arabinose, as well as combinations, oligomers, and/or modified or substituted forms thereof.

The phrase "simultaneous saccharification and fermentation process" shall mean hereinafter a process for making a fuel or chemical such as ethanol from a biomass that may or may not have been pretreated by chemical means, and where cellulase and/or hemicellulase enzyme(s) are used to break down biomass polysaccharides into sugars (saccharification); and the sugars are fermented by source(s) of microorganism(s) into the product fuel or chemical (fermentation). These two processes occur at the same time, in the same reaction vessel (simultaneous).

The phrase "end product" as used in the present application shall mean hereinafter the chemical(s) that is/are produced by a chemical or enzymatic reaction. Examples of end products contemplated by the present invention include simpler saccharides and sugars (e.g., monomers, dimers, trimers, oligomers, etc.), alcohols, fuels, and/or other products of an enzymatic reaction.

The word "biomass" in the context of the present invention shall mean plant and other lignocellulosic material such as corn stalks, wheat straw, and wood by-products, such as sawdust and the like.

The phrase "pretreatment of a biomass slurry" shall mean, in the context of the present application, the preparation of a biomass for its subsequent conversion to fuels, such as ethanol. This pretreatment includes the steps of grinding the biomass to a powder or small particles, and adding water (this constitutes a slurry). This slurry is then treated by a number of methods designed to partially or completely remove the lignin from the biomass, and convert the hemicellulose and cellulose into a form that can be more easily degraded into their component sugars using enzymes such as cellulases and hemicellulases. Some pretreatments degrade hemicellulose to its component sugars while leaving the cellulose as part of the solid residue. This treatment step is called a "pretreatment" because it occurs before both the enzymatic degradation step and before the fermentation step that converts the sugars into ethanol.

The phrase "water-soluble" in the context of the present invention shall mean a chemical or other substance that can be dissolved completely in water without leaving any solid residue.

The word "hemicellulose" in the context of the present invention means one component of a plant (the other two being cellulose and lignin), that is made of a linear chain of sugars such as xylose, or mannose that are connected by a chemical bond. This linear chain also has branches consisting of sugars and other chemicals along the chain.

The word "hemicellulase" in the context of the present invention means a class of enzymes that can break hemicellulose into its component sugars and other chemical monomers. Examples of hemicellulases include, but are not limited to, xylanases, mannanases, glucuronidases, and arabinofuranosidases.

The phrase "sequential hydrolysis and fermentation process" in the context of the present invention shall mean a process for making a fuel or chemical from the biomass, such as ethanol, and where the biomass is treated physically or with a reactive chemical or solvent, or mixtures thereof, to remove the lignin, and to convert the cellulose and hemicellulose present in the biomass into their component sugars or into a form that can be more easily degraded into their component sugars using enzymes such as cellulases and hemicellulases. Examples of these include grinding, milling, acids, alkalis, organosolvents, and the like. These treatments can be performed at temperatures ranging from ambient to 300° C. or more, and at pressures ranging from ambient to 2000 psig or more. The sugars, which are dissolved in water, are then cooled, and the pH adjusted to neutral, and then subsequently fermented by microorganisms of various types into a product fuel(s) or chemical(s) (fermentation). These two processes occur in separate reaction vessels with the hydrolysis step conducted first, and the fermentation step conducted second (e.g., sequential).

The phrase "cultivating *Alicyclobacillus acidocaldarius*" in the context of the present invention shall mean providing the aforementioned microbe with a food source (soluble or insoluble lignocellulose or other source of polysaccharides or sugars) and various vitamins and minerals dissolved in water (this constitutes the nutrient medium), and giving the microbe the proper conditions that allow it to grow (a temperature of 140° F. (60° C.), a pH of 3.5, and oxygen).

The phrase "separating the cells of the *Alicyclobacillus acidocaldarius*" in the context of the present invention shall include means for removing the bacterial cells from the nutrient medium by, for example, centrifugation.

The phrase "recovering and purifying the hemicellulase" in the context of the present invention shall mean separating the hemicellulase enzyme from the nutrient medium. In the present invention, a process called cation exchange was used to separate hemicellulase from the nutrient medium. In this regard, the nutrient medium (with hemicellulase) was pumped through the cation exchange material. When brought into contact with the cation exchange material, the hemicellulase will attach itself to the cation exchange material, but the nutrient medium will pass through. The hemicellulase enzyme is then removed from the cation exchange material and is purified.

The phrase "microbial nutrient medium" in the context of the present application means a food source for the microbe (*Alicyclobacillus acidocaldarius*) and vitamins and minerals, all dissolved in water and adjusted to the pH needed by the microbe to grow. More specifically, the microbial nutrient medium includes about 1 gram per liter of Xylan; about 10 mM $NH_4Cl$; about 5.2 mM $K_2HPO_4$; about 0.8 mM $MgSO_4.7H_2O$; about 1.74 mM $Na_2SO_4$; about 25 mg per liter $MgCl_2$; about 6.6 mg per liter of $CaCl_2$; about 2.0 mg per liter $MnSO_4$; about 0.5 mg per liter $ZnSO_4$; about 0.5 mg per liter of boric acid; about 5 mg per liter of $FeCl_3$; about 0.15 mg per liter of $CuSO_4$; about 0.025 mg per liter of $NaMoO_4$; about 0.05 mg per liter of $CoNO_3$; about 0.02 mg per liter of $NiCl_2$; about 0.08 mg per liter of pyridoxine hydrochloride; about 0.01 mg per liter of folic acid; about 0.1 mg per liter of thiamine hydrochloride; about 0.04 mg per liter of riboflavin; about 0.08 mg per liter of nicotinamide; about 0.08 mg per liter of p-aminobenzoate; about 0.01 mg per liter of biotin; about 0.0004 mg per liter cyanocobalamin; about 0.08 mg per liter D-pantothenic acid-Ca; about 0.02 mg per liter of myo-inositol; about 0.05 mg per liter of choline bromide; about 0.02 mg per liter of monosodium orotic acid; and about 0.1 mg per liter spermidine, wherein the resulting nutrient medium is adjusted to a pH of about 3.5.

The word "supernatant" in the context of the preknt application shall mean the nutrient medium that is leftover after the bacterial cells are substantially removed from same.

The inventors have isolated and characterized temperature and acid stable endoglucanase and/or xylanases that demonstrate activity at elevated temperatures, and low pH, and that show stability when incubated under these conditions for extended periods of time. The inventors recognize that heat and acid stable hemicellulases and cellulases, as described hereinafter, have particular value in, or as an accessory to, processes that would lead, on the one hand, to the reduction in the severity of pretreatment processes, earlier described, and/or the elimination of these limitations in various processes. In this regard, the inventors screened numerous organisms from Yellowstone National Park and various culture collections for microbes that had the ability to produce enzymes that were stable at both high temperature, and low pH. In this regard, water and sediment samples were collected from six springs in the Norris Geyser Basin of Yellowstone National Park. These samples were inoculated into a liquid mineral salt medium having a pH 3.5, and further containing either 0.5 grams per liter of oat spelt xylan, or 0.5 grams per liter of ground corn cobs. The subsequent cultures were incubated at 80° C. and were observed daily for growth, both visually and microscopically. Still further, a search of the American Type Culture Collection (ATCC) and the Deutsche Sammlung von Mikroorganismen Und Zellkulturen (DSMZ) yielded four possible heterotrophic organisms whose optimal temperatures, and pH, for growth, were greater than about 60° C., and less than about a pH of 4. These several organisms were grown in the media recommended by ATCC or DSMZ with a carbon source replaced by either oat spelt xylan, or ground corn cobs, as described above. These cultures where then later incubated at their optimum growth temperature and a pH of 3.5. Subsequent microbial growth was assessed visually by the appearance of turbidity.

In this investigation, hemicellulase and/or cellulase activities were presumptively assumed present if growth occurred in the presence of xylan. Cultures where growth occurred were harvested after approximately three days incubation. Cells were removed from the culture by centrifugation. The culture supernatant was concentrated at about 1000-2000 fold using an AMICON® ultrafiltration cell with a 10000 MWCO membrane. The subsequent supernatant concentrate was then tested for hemicellulase and cellulase activity using arsenomolybdate reducing sugar acid assay (previously described by Somogyi (1952), *J. Biol. Chem.* 195:19-23) with wheat arabinoxylan (commercially secured from Megazyme), or carboxymethylcellulose (secured from Sigma-Aldrich). These were used as substrates for the hemicellulase and cellulase activities, respectively. Standard conditions for the assays were set at 60° C., and a pH of about 3.5. As will be seen by reference to the drawings, the hemicellulase and cellulase activities were measured at temperatures up to about 90° C. to determine the optimum temperature for enzymatic activity. The reducing sugar assay referenced above was modified by changing the incubation temperature of the supernatant concentrate with the substrate. Similarly, the enzyme activities were measured at a pH ranging from 1 to about 8 to determine the optimum pH for the enzyme activity. For these studies, the reducing sugar assay was modified by preparing the assay components in the appropriate pH buffer (pH 1-2, 50 mM sodium maleate or 50 mM glycine; pH 2-6, 50 mM sodium acetate; pH 6-8, 50 mM sodium phosphate; and pH 8-9, 50 mM Tris).

In addition to the foregoing, stabilities of the hemicellulases and cellulases as a function of temperature and pH were examined by incubating the supernatant concentrate at a temperature of about 70° C., and a pH of 2.0. In this regard, a layer of mineral oil was placed over the concentrate to limit evaporation during this exam. Samples were periodically collected and assayed for hemicellulase and cellulase activity at the standard assayed conditions earlier described. With respect to the hemicellulase and cellulase reaction kinetics, these were determined using the reducing sugar assay with varying amounts of wheat arabinoxylan or carboxymethylcellulose. The reaction kinetics were determined at 60° C. and a pH of 3.5. Michaelis-Menten parameters Vmax and Km were calculated by nonlinear analysis using ENZYME KINETICS PRO™ that is available through SynexChem. After the process noted above, the inventors identified *Alicyclobacillus acidocaldarius* (ATCC 27009) for further examination.

Figure 22:
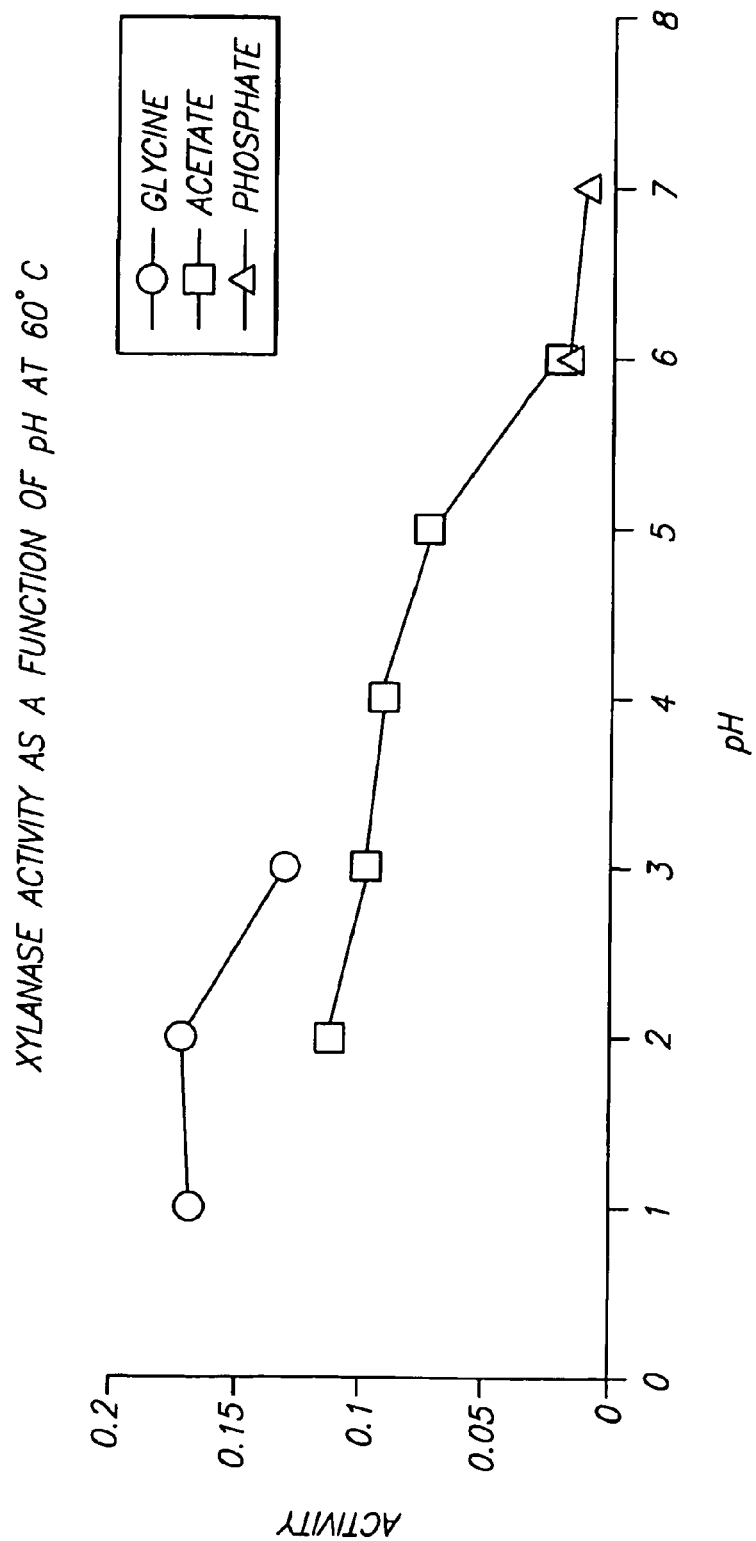
FIG. 22 is a graph depicting an effect of pH on xylanase activity of the present invention at a temperature of 60° C.

Subsequently, a crude enzyme preparation was made by concentrating the cell free culture material. A subsequent SDS-page gel showed five major bands and several minor bands. The subsequently calculated masses of these bands were consistent with other reported xylanases and cellulases. As seen in FIGS. 19, 20, 21, and 22, the inventors discovered that the enzyme isolated from the *Alicyclobacillus acidocaldarius*, which is identified herein as ATCC 27009, had an optimum temperature for enzymatic activity (xylanase and cellulase) at about 80° C. As seen in FIG. 19, the relative enzymatic activity is contrasted against the enzymatic activity that is provided by a similar enzyme that is isolated from another similar microbe *T. lanuginosus*. Further, it was found that the isolated endoglucanase and/or xylanase exhibited enzymatic activity at a pH as low as 1, with an optimum pH of 2, while the optimum pH for the cellulase activity was at a pH of about 4, although it did show some activity at a pH as low as 2. FIG. 22 shows the xylanase activity as a function of pH as described above. To the best knowledge of the inventors, the lowest optimum hemicellulase pH previously reported was in the reference to Collins (2005, *FEMS, Micro. Review* 29(1):3-23). It is conceivable that the present water-soluble endoglucanase and/or xylanase enzyme that has been isolated perhaps has activity at a pH lower than 1, however, presently, the reducing sugar assay reagents were unstable below a pH of 1. Further investigation revealed that the newly isolated hemicellulase and cellulase activities showed no decrease in activity when incubated at 70° C. and a pH of 2. The aforementioned investigation lead the inventors to conclude that the *Alicyclobacillus acidocaldarius* (ATCC 27009) is capable of growth on a xylan substrate, and further produces extracellular hemicellulase and cellulase activity, which are both water-soluble and display significant hemicellulase activity at a pH of about 2, and which further has a molecular weight of at least about 120 kDa. Again, see FIG. 22.

The prior art discloses that an acid stable xylanase has been purified and characterized from *Aspergillus kawachii* that has a pH optimum of 2.0 and a temperature optimum between 50° C. to 60° C. (Purification and Properties of Acid Stable Xylanases From *Aspergillus kawachii*, K. Ito, H. Ogasawara, T. Sugomoto, and T. Ishikawa, *Bioscience, Biotechnology and Biochemistry* 56 (4):547-550, April 1992.) Additionally, several xylanases have been reported with pH optima in the range of 4 to 5, and numerous xylanases have been reported that have temperature optima up to 100° C. However, in the inventors' knowledge, the enzyme as described hereinafter, is the first enzyme known that has activities at such a low pH, and at such a high temperature, as claimed herein. In addition to the foregoing, the inventors are aware that a xylanase has been purified from the same organism, that is, *Alicyclobacillus acidocaldarius* (ATCC 27009), that is reported to have xylanase activity associated with it. It is reported that this enzyme had a pH optimum of 4.0, and a temperature optimum of about 80° C. In this regard, a thermoacidophilic endoglucanase and/or xylanase (celB) from *Alicyclobacillus acidocaldarius* (ATCC 27009) displayed high sequence similarity to arabinofuranosidases belonging to Family 51 of glycoside hydrolases (K. Eckert and E. Schneider, *European Journal of Biochemistry* 270 (17):3593-3602, September, 2003). The aforementioned cellulase precursor as described in this prior art reference is best understood by a study of SEQ ID NO:307, which is shown below:

```
  1  MKRPWSAALA ALIALGTGAS PAWAAAHPSP KVPAGAAGRV RAADVVSTPI
 51  SMEIQVIHDA LTVPELAAVQ AAAQAASNLS TSQWLQWLYP NATPTTSAQS
101  QAAQAVANLF NLATYGAVST RGSNAAQILQ TLQSISPLLS PRAVGLFYQS
151  FLTEIGQSSK AILARQASSS IVGNALAQAA SLSPTISAYL RQNGLSPSDL
201  ARTWSSFETQ VDPQGAAQTA LATRICTNAL GFGAPTASAT ITVNTAARLR
251  TVPATAFGLN AAVWDSGLNS QTVISEVQAL HPALIRWPGG SISDVYNWET
301  NTRNDGGYVN PNDTFDNFMQ FVNAVGASPI ITVNYGTGTP QLAADWVKYA
351  DVTHHDNVLY WEIGNEIYGN GYYNGNGWEA DDHAVPNQPQ KGNPGLSPQA
401  YAQNALQFIQ AMRAVDPNIK IGAVLTMPYN WPWGATVNGN DDWNTVVLKA
451  LGPYIDFVDV HWYPETPGQE TDAGLLADTD QIPAMVAELK REINAYAGSN
501  AKNIQIFVTE TNSVSYNPGQ QSTNLPEALF LADDLAGFVQ AGAANVDWWD
551  LLNGAEDNYT SPSLYGQNLF GDYGLLSSGQ ATPKGVQEPP QYTPLPPYYG
601  FQLVSDFARP GDTLLGSASS QSDIDVHAVR EPNGDIALML VNRSPSTIYS
651  ADLNVLGVGP YAITKALVYG EGSSAVSPAL TLPTAHSVKL MPYSGVDLVL
701  HPLIPAPHAA ASVTDTLALS SPTVTAGGSE TVTASFSSDR PVRDATVELE
751  LYDSTGDLVA NHEMTGVDIA PGQPVSESWT FAAPAANGTY TVEAFAFDPA
801  TGATYDADTT GATITVNQPP AAKYGDIVTK NTVITVNGTT YTVPAPDASG
851  HYPSGTNISI APGDTVTIQT TFANVSSTDA LQNGLIDMEV DGQNGAIFQK
901  YWPSTTLLPG QTETVTATWQ VPSSVSAGTY PLNFQAFDTS NWTGNCYFTN
951  GGVVNFVVN
```

In embodiments of the invention, SEQ ID NO:307 may be glycosylated. In further embodiments, SEQ ID NO:307 may be glycosylated at least at positions 174, 193, 297, 393, and 404.

With respect to the present invention, the new enzyme that was isolated from an extremophilic microbe has an N-terminal sequence comprising SEQ ID NO:326 as shown below:

DVVSTPISMEIQV.

It will be noted, that this N-terminal sequence of the present enzyme aligns/corresponds to positions 44-56 of SEQ ID NO:307.

In the present invention, an enzyme as contemplated by the present invention and that is isolated from an extremophilic microbe comprises that which is seen in SEQ ID NO:327, which is provided below:

QASSSIVGNALAQAASLSPTISAYLRQNGLSPSDLARTWSSYYCTQFDDP

QGAAQTALATRICNDQALGGGAPTASATITVNTAAR.

As should be understood, this SEQ ID NO:327 aligns/corresponds to positions 166-248 of the celB sequence as seen in SEQ ID NO:307. It should be noted, that SEQ ID NO:327 includes changed amino acids at positions 207, 208, 212, 229, and 231; and added amino acids at positions 209, 213, and 230, respectively.

In the present invention, the enzyme of the present invention may be further characterized, and is best understood by a study of SEQ ID NO:328 below:

GLNAAVWDSGLNSQTVISEVQALHPALIRWPGGSISDMDYNWETNTR

As should be understood SEQ ID NO:328, aligns/corresponds to positions 258-304 of SEQ ID NO:307. It should be noted that SEQ ID NO:328 has a changed amino acid at position number 295, and an additional amino acid at position 296.

In the present invention, the enzyme as contemplated by the present invention further comprises the SEQ ID NO:329 as seen below:

EADDHAVPNQPQKGNPGLSPQAYAQNALQFMQSPVVYYR.

SEQ ID NO:329 aligns/corresponds to positions 379-415 of SEQ ID NO:307. It should be understood that with respect to the earlier SEQ ID NO:307, the present SEQ ID NO:329 has changes in amino acids at positions 409, 411, and 413, respectively. Still further, additional amino acids are located at positions 412, 414, and 415, respectively.

In the prior art reference noted above to Eckert and Schneider, it is observed that work had been conducted on the *Alicyclobacillus acidocaldarius* (ATCC 27009) for purposes of determining the presence of extracellular thermoacidophilic enzymes with polysaccharide-degrading activities. The authors noted that the organism was found to utilize a variety of polysaccharides including xylan as a sole source of carbon and energy. However, the authors failed to detect xylanase activity in the culture supernatant. The authors assumed a cell-associated enzyme and succeeded in extracting cellulose degrading activity with associated xylan degrading activity from the intact cells with TRITON™ X-100. The authors observed that the cellulose degrading activity and its associated xylanase activity remained cell bound even after the culture reached the stationary phase of growth. In contrast, the enzyme isolated from the extremophilic microbe of the present invention that displays optimum enzymatic activities at temperatures equal to or greater than 80° C. and at a pH of less than 2, is considered to be water-soluble, and further has been isolated from cell supernatant.

The present invention is also directed to a method for the preparation of a hemicellulase that includes the steps of providing a source of *Alicyclobacillus acidocaldarius* (ATCC 27009); cultivating the *Alicyclobacillus acidocaldarius* (ATCC 27009) in a microbial nutrient medium having a supernatant; separating the cells of the *Alicyclobacillus acidocaldarius* from the nutrient medium supernatant; and recovering and purifying the hemicellulase derived from the *Alicyclobacillus acidocaldarius* (ATCC 27009) from the nutrient medium supernatant. The methodology, as described, produces a hemicellulase that is water-soluble and displays significant enzymatic activity at a pH of less than about 2, and at temperatures greater than about 80° C. In the methodology as described, the hemicellulase comprises the sequence as depicted in SEQ ID NOS:326, 327, 328, and/or 329. Still further, and in the methodology as described, the nutrient medium that is utilized further includes about 1 gram per liter of Xylan, about 10 mM $NH_4Cl$, about 5.2 mM $K_2HPO_4$, about 0.8 mM $MgSO_4$-$7H_2O$, about 1.74 mM $Na_2SO_4$, about 25 mg per liter $MgCl_2$, about 6.6 mg per liter of $CaCl_2$, about 2.0 mg per liter $MnSO_4$, about 0.5 mg per liter $ZnSO_4$, about 0.5 mg per liter of boric acid, about 5 mg per liter of $FeCl_3$, about 0.15 mg per liter of $CuSO_4$, about 0.025 mg per liter of $NaMoO_4$, about 0.05 mg per liter of $CoNO_3$, about 0.02 mg per liter of $NiCl_2$, about 0.08 mg per liter of pyridoxine hydrochloride, about 0.01 mg per liter of folic acid, about 0.1 mg per liter of thiamine hydrochloride, about 0.04 mg per liter of riboflavin, about 0.08 mg per liter of nicotinamide, about 0.08 mg per liter of p-aminobenzoate, about 0.01 mg per liter of biotin, about 0.0004 mg per liter cyanocobalamin, about 0.08 mg per liter D-pantothenic acid-Ca, about 0.02 mg per liter of myo-inositol, about 0.05 mg per liter of choline bromide, about 0.02 mg per liter of monosodium orotic acid, and about 0.1 mg per liter spermidine, wherein the resulting nutrient medium is adjusted to a pH of about 3.5. As discussed earlier in the application, the present enzyme may be used in various processes. Therefore, the methodology, as described above, includes the step of supplying the recovered and purified hemicellulase to a simultaneous saccharification and fermentation process to facilitate the conversion of a biomass polysaccharide into an end product. One process for using the enzyme as noted above includes a step of pretreating a biomass slurry with the recovered and purified hemicellulase or with a crude enzyme preparation prepared from the organism containing a majority of the protein comprised of the hemicellulase to degrade an oligomer and/or polysaccharide that is present in the biomass slurry to produce an end product.

Other possible methods for using the enzyme as described above may be employed. For example, the enzyme that has been isolated from the extremophilic microbe may be used in a method for hydrolyzing a polysaccharide, which includes the step of providing a water-soluble hemicellulase derived from an extremophilic microbe; and conducting hydrolysis of a polysaccharide with the water-soluble hemicellulase at a pH of less than about 2. As was discussed, earlier, the water-soluble hemicellulase has an optimal enzymatic activity at a temperature of about 80° C.

OPERATION

The operation of the described embodiment of the present invention is believed to be readily apparent and is briefly summarized at this point.

As described, an enzyme isolated from extremophilic microbe that displays optimum enzymatic activity at a temperature of about 80° C. and a pH of less than about 2 is best understood by a study of SEQ ID NOS:327-329, respectively. The enzyme that has been isolated is useful in a method for treating a biomass, which includes the steps of providing a source of a biomass having a biomass sugar; pretreating the biomass with a water-soluble hemicellulase derived from *Alicyclobacillus acidocaldarius* (ATCC 27009) to produce an end product. In the present methodology, the biomass sugar comprises a polysaccharide, and the hemicellulase hydrolyzes the polysaccharide. As discussed above, the hemicellulase displays enzymatic activity at a pH of less than about 2, and at temperature of greater than about 80° C.

The hemicellulase, as contemplated by the present invention, has a molecular weight of about 120 kDa. In the methodology as described above, the methodology includes additional steps of pretreating the biomass in the presence or absence of the hemicellulase; providing a sequential hydrolysis and fermentation process to convert the biomass sugar into the end product; and supplying the hemicellulase to the sequential hydrolysis and fermentation process to facilitate the conversion of the biomass sugar into the end product. After the step of pretreating the biomass as discussed above, which can be performed at reduced severity in the presence or absence of the hemicellulase, the method includes a further step of providing a simultaneous saccharification and fermentation process to convert the biomass sugar into the end product; and supplying the hemicellulase to the simultaneous saccharification and fermentation process to facilitate the conversion of the biomass sugar into the end product.

Therefore, it will be seen that the present enzyme and methodology, as described above, avoids many of the shortcomings attendant with the prior art enzymes and practices employed heretofore, and further provides a convenient means for producing various desirable end products, while simultaneously reducing the severity of pretreatment steps that had the propensity for generating various deleterious waste products, as well as for increasing the cost of the overall process through the requirement of high temperatures, pressures and quantities of acid to attain the high pretreatment severity.

Embodiments of the invention include methods of post-translationally modifying proteins. In some embodiments, the post-translational modification may occur using isolated or partially purified glycosyltransferases and/or post-translational modification proteins, extracts of cells comprising glycosyltransferases and/or post-translational modification proteins, and/or in cells comprising one or more glycosyltransferases and/or post-translational modification proteins. Glycosyltransferases and/or post-translational modification proteins may be, without limitation, of the following classes: UDP beta-glucosephosphotransferases, Dolichol-phosphate mannosyltransferases, and Glycosyltransferases. In some embodiments, the glycosyltransferases and/or post-translational modification proteins may be those of a thermoacidophilic organism. Examples of thermoacidophiles, include, but are not limited to, *Alicyclobacillus acidocaldarius*, and those organisms belonging to the genera *Acidianus, Alicyclobacillus, Desulfurolobus, Stygiolobus, Sulfolobus, Sulfurisphaera, Sulfurococcus, Thermoplasma,* and *Picrophilus*. Examples of glycosyltransferases and/or post-translational modification proteins include, but are not limited to, those provided by SEQ ID NOS:1, 18, 35, 52, 69, 86, 103, 120, 137, 154, 171, 188, 205, 222, 239, 256, 273, and 290, as well as those available from the NCBI at accession numbers XP_002490630.1, Q54IL5.1, ABN66322.2, XP_002493240.1, XP_002491463.1, XP_002491326.1, CAY71061.1, NP_344219.1, NP_343051.1, ACR41289.1, ACP37471.1, NP_111396.1, NP_111382.1, NP_394039.1, NP_394183.1, YP 023099.1, P_023093.1, AAT43750.1, and AAT42890.1. Embodiments of the invention also include proteins glycosylated according to methods of the invention. Examples of such proteins include, but are not limited to, glycosylated forms of the proteins of SEQ ID NOS:307, 331, 333, 335, 337, and 338.

Embodiments of the invention include methods of altering the physical and/or kinetic properties of an endoglucanase and/or xylanase from a thermoacidophile. In some embodiments, the ratio of cellulase activity to xylanase activity of an endoglucanase and/or xylanase from a thermoacidophile is altered by post-translational modification of the endoglucanase and/or xylanase. In some embodiments, the post-translational modification may be glycosylation. In further embodiments, the solubility of an endoglucanase and/or xylanase from a thermoacidophile is altered by post-translational modification of the endoglucanase and/or xylanase. In some embodiments, the endoglucanase and/or xylanase is an endoglucanase and/or xylanase of *Alicyclobacillus acidocaldarius*. In further embodiments, the endoglucanase and/or xylanase is celB (SEQ ID NO:307).

Embodiments of the invention include modification of the ratio of cellulase activity to xylanase activity of SEQ ID NO:307 through glycosylation of SEQ ID NO:307. Glycosylation of SEQ ID NO:307 may be performed, by way of non-limiting example, by expression of a sequence encoding SEQ ID NO:307 in an organism capable of glycosylating SEQ ID NO:307, by exposure of SEQ ID NO:307 to an enzyme having glycosylating activity or a cell producing an enzyme having glycosylating activity; or by chemical methods known in the art.

In further embodiments of the invention, the ratio of cellulase activity to xylanase activity of an endoglucanase and/or xylanase may be altered based on the level and location of post-translational modification. In some embodiments, the level and location of post-translational modification may be manipulated, by way of non-limiting examples, through the use of different enzymes having glycosylating activity, different cells capable of glycosylating a protein, different chemical methods of glycosylation, and/or by varying the amount of glycosylating activity or time the endoglucanase and/or xylanase is exposed to. In some embodiments, post-translational modification of the endoglucanase and/or xylanase results in increased xylanase activity at an acidic pH. In some embodiments, the modified form of the endoglucanase and/or xylanase has increased xylanase activity compared to an un-modified form of the endoglucanase and/or xylanase at, by way of non-limiting example, pH of less than about 5, pH of about 5, pH of about 3.5, and pH of about 2.

In some embodiments, post-translational modification of the endoglucanase and/or xylanase results in greater solubility at an acidic pH. In some embodiments, the modified form of the endoglucanase and/or xylanase is more soluble that the un-modified form of the endoglucanase and/or xylanase at, by way of non-limiting example, pH of less than about 5, pH of about 5, pH of about 3.5, and pH of about 2.

Embodiments of the invention include genes and associated proteins related to the glycosylation and/or post-translational modification of proteins of the thermoacidophile *Alicyclobacillus acidocaldarius*. Coding sequences for genes related to these processes were determined from sequence information generated from sequencing the genome of *Alicyclobacillus acidocaldarius*. These genes and proteins may represent targets for metabolic engineering of *Alicyclobacillus acidocaldarius* or other organisms. Non-limiting examples of nucleotide sequences found within the genome of *Alicyclobacillus acidocaldarius*, and amino acids coded thereby, associated with glycosylation and/or post-translational modification of proteins are listed in Table 1. Glycosyltransferases and/or post-translational modification proteins may be, without limitation, of the following classes: UDP beta-glucosephosphotransferases, Dolichol-phosphate mannosyltransferases, and Glycosyltransferases; and others.

Embodiments of the invention relate in part to the gene sequences and/or protein sequences comprising genes and/or proteins of *Alicyclobacillus acidocaldarius*. Genes and proteins included are those which play a role in glycosylation and/or post-translational modification of proteins. Intracellular enzyme activities may be thermophilic and/or acidophilic in nature and general examples of similar genes are described in the literature. Classes of genes, sequences, enzymes and factors include, but are not limited to, those listed in Table 1.

TABLE 1

*Alicyclobacillus acidocaldarius* genes and proteins related to glycosylation

| Reference | Protein Sequence | Gene Sequence | Function |
|---|---|---|---|
| RAAC00164 | SEQ ID NO: 1 | SEQ ID NO: 2 | Glycosyltransferase |
| RAAC00517 | SEQ ID NO: 18 | SEQ ID NO: 19 | Glycosyltransferase |
| RAAC00650 | SEQ ID NO: 35 | SEQ ID NO: 36 | Glycosyltransferase |
| RAAC00991 | SEQ ID NO: 52 | SEQ ID NO: 53 | Glycosyltransferase |
| RAAC01110 | SEQ ID NO: 69 | SEQ ID N0: 70 | Glycosyltransferase |
| RAAC01166 | SEQ ID NO: 86 | SEQ ID NO: 87 | UDP beta-glucose-phosphotransferase |
| RAAC01167 | SEQ ID NO: 103 | SEQ ID NO: 104 | Glycosyltransferase |
| RAAC01170 | SEQ ID NO: 120 | SEQ ID NO: 121 | Glycosyltransferase |
| RAAC01248 | SEQ ID NO: 137 | SEQ ID NO: 138 | Glycosyltransferase |
| RAAC01348 | SEQ ID NO: 154 | SEQ ID NO: 155 | Glycosyltransferase |
| RAAC01377 | SEQ ID NO: 171 | SEQ ID NO: 172 | Glycosyltransferase |
| RAAC01611 | SEQ ID NO: 188 | SEQ ID NO: 189 | Glycosyltransferase |
| RAAC01612 | SEQ ID NO: 205 | SEQ ID NO: 206 | Glycosyltransferase |
| RAAC01926 | SEQ ID NO: 222 | SEQ ID NO: 223 | Glycosyltransferase |
| RAAC01998 | SEQ ID NO: 239 | SEQ ID NO: 240 | Glycosyltransferase |
| RAAC02011 | SEQ ID NO: 256 | SEQ ID NO: 257 | Dolichol-phosphate mannosyltransferase |
| RAAC02381 | SEQ ID NO: 273 | SEQ ID NO: 274 | Glycosyltransferase |
| RAAC02421 | SEQ ID NO: 290 | SEQ ID NO: 291 | Glycosyltransferase |

The present invention relates to nucleotides sequences comprising isolated and/or purified nucleotide sequences of the genome of *Alicyclobacillus acidocaldarius* selected from the sequences of SEQ ID NOS:2, 19, 36, 53, 70, 87, 104, 121, 138, 155, 172, 189, 206, 223, 240, 257, 274, 291, 332, 334, 336, 339, and 340, or one of their fragments.

The present invention likewise relates to isolated and/or purified nucleotide sequences, characterized in that they comprise at least one of: a) a nucleotide sequence of at least one of the sequences of SEQ ID NOS:2, 19, 36, 53, 70, 87, 104, 121, 138, 155, 172, 189, 206, 223, 240, 257, 274, 291, 332, 334, 336, 339, and 340 or one of their fragments; b) a nucleotide sequence homologous to a nucleotide sequence such as defined in a); c) a nucleotide sequence complementary to a nucleotide sequence such as defined in a) or b), and a nucleotide sequence of their corresponding RNA; d) a nucleotide sequence capable of hybridizing under stringent conditions with a sequence such as defined in a), b) or c); e) a nucleotide sequence comprising a sequence such as defined in a), b), c) or d); and f) a nucleotide sequence modified by a nucleotide sequence such as defined in a), b), c), d) or e).

Nucleotide, polynucleotide, or nucleic acid sequence will be understood according to the present invention as meaning both a double-stranded or a single-stranded nucleic acid in the monomeric and dimeric (so-called "in tandem") forms and the transcription products of the nucleic acids.

Aspects of the invention relate nucleotide sequences which it has been possible to isolate, purify or partially purify, starting from separation methods such as, for example, ion-exchange chromatography, by exclusion based on molecular size, or by affinity, or alternatively, fractionation techniques based on solubility in different solvents, or starting from methods of genetic engineering such as amplification, cloning, and subcloning, it being possible for the sequences of the invention to be carried by vectors.

An isolated and/or purified nucleotide sequence fragment according to the invention will be understood as designating any nucleotide fragment of the genome of *Alicyclobacillus acidocaldarius*, and may include, by way of non-limiting examples, length of at least 8, 12, 20 25, 50, 75, 100, 200, 300, 400, 500, 1000, or more, consecutive nucleotides of the sequence from which it originates.

Specific fragment of an isolated and/or purified nucleotide sequence according to the invention will be understood as designating any nucleotide fragment of the genome of *Alicyclobacillus acidocaldarius*, having, after alignment and comparison with the corresponding fragments of genomic sequences of *Alicyclobacillus acidocaldarius*, at least one nucleotide or base of different nature.

An homologous isolated and/or purified nucleotide sequence in the sense of the present invention is understood as meaning an isolated and/or purified nucleotide sequence having at least a percentage identity with the bases of a nucleotide sequence according to the invention of at least about 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7%, this percentage being purely statistical and it being possible to distribute the differences between the two nucleotide sequences at random and over the whole of their length.

Specific homologous nucleotide sequence in the sense of the present invention is understood as meaning a homologous nucleotide sequence having at least one nucleotide sequence of a specific fragment, such as defined above. The "specific" homologous sequences can comprise, for example, the sequences corresponding to the genomic sequence or to the sequences of its fragments representative of variants of the genome of *Alicyclobacillus acidocaldarius*. These specific homologous sequences can thus correspond to variations linked to mutations within strains of *Alicyclobacillus acidocaldarius*, and especially correspond to truncations, substitutions, deletions and/or additions of at least one nucleotide. The homologous sequences can likewise correspond to variations linked to the degeneracy of the genetic code.

The term "degree or percentage of sequence homology" refers to "degree or percentage of sequence identity between two sequences after optimal alignment" as defined in the present application.

Two amino-acids or nucleotidic sequences are said to be "identical" if the sequence of amino-acids or nucleotidic residues, in the two sequences is the same when aligned for maximum correspondence, as described below. Sequence comparisons between two (or more) peptides or polynucleotides are typically performed by comparing sequences of two optimally aligned sequences over a segment or "comparison window" to identify and compare local regions of sequence similarity. Optimal alignment of sequences for comparison may be conducted by the local homology algorithm of Smith and Waterman, *Ad. App. Math.* 2:482 (1981), by the homology alignment algorithm of Neddleman and Wunsch, *J. Mol. Biol.* 48:443 (1970), by the search for similarity method of Pearson and Lipman, *Proc. Natl. Acad. Sci. (USA)* 85:2444 (1988), by computerized implementation of these algorithms (GAP, BESTFIT, FASTA, and TFASTA in the Wisconsin Genetics Software Package, Genetics Computer Group (GCG), 575 Science Dr., Madison, Wis.), or by visual inspection.

"Percentage of sequence identity" (or degree of identity) is determined by comparing two optimally aligned sequences over a comparison window, where the portion of the peptide or polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical amino-acid residue or nucleic acid base occurs in both sequences to yield the number of matched positions, dividing the number of matched positions by the total number of positions in the window of comparison and multiplying the result by 100 to yield the percentage of sequence identity.

The definition of sequence identity given above is the definition that would be used by one of skill in the art. The definition by itself does not need the help of any algorithm, the algorithms being helpful only to achieve the optimal alignments of sequences, rather than the calculation of sequence identity.

From the definition given above, it follows that there is a well-defined and only one value for the sequence identity between two compared sequences, which value corresponds to the value obtained for the best or optimal alignment.

In the BLAST N or BLAST P "BLAST 2 sequence," software which is available at the web site worldwideweb.ncbi.nlm.nih.gov/gorf/b12.html, and habitually used by the inventors and in general by the skilled person for comparing and determining the identity between two sequences, gap cost which depends on the sequence length to be compared is directly selected by the software (i.e., 11.2 for substitution matrix BLOSUM-62 for length>85).

Complementary nucleotide sequence of a sequence of the invention is understood as meaning any DNA whose nucleotides are complementary to those of the sequence of the invention, and whose orientation is reversed (antisense sequence).

Hybridization under conditions of stringency with a nucleotide sequence according to the invention is understood as meaning hybridization under conditions of temperature and ionic strength chosen in such a way that they allow the maintenance of the hybridization between two fragments of complementary DNA.

By way of illustration, conditions of great stringency of the hybridization step with the aim of defining the nucleotide fragments described above are advantageously the following.

The hybridization is carried out at a preferential temperature of 65° C. in the presence of SSC buffer, 1×SSC corresponding to 0.15 M NaCl and 0.05 M Na citrate. The washing steps, for example, can be the following: 2×SSC, at ambient temperature followed by two washes with 2×SSC, 0.5% SDS at 65° C.; 2×0.5×SSC, 0.5% SDS; at 65° C. for 10 minutes each.

The conditions of intermediate stringency, using, for example, a temperature of 42° C. in the presence of a 2×SSC buffer, or of less stringency, for example, a temperature of 37° C. in the presence of a 2×SSC buffer, respectively, require a globally less significant complementarity for the hybridization between the two sequences.

The stringent hybridization conditions described above for a polynucleotide with a size of approximately 350 bases will be adapted by a person skilled in the art for oligonucleotides of greater or smaller size, according to the teachings of Sambrook et al., 1989.

Among the isolated and/or purified nucleotide sequences according to the invention, are those that can be used as a primer or probe in methods allowing the homologous sequences according to the invention to be obtained. These methods, such as the polymerase chain reaction (PCR), nucleic acid cloning, and sequencing, are well known to a person skilled in the art.

Among the isolated and/or purified nucleotide sequences according to the invention, those are again preferred which can be used as a primer or probe in methods allowing the presence of SEQ ID NOS:2, 19, 36, 53, 70, 87, 104, 121, 138, 155, 172, 189, 206, 223, 240, 257, 274, 291, 332, 334, 336, 339, and 340, one of their fragments, or one of their variants such as defined below to be diagnosed.

The nucleotide sequence fragments according to the invention can be obtained, for example, by specific amplification, such as PCR, or after digestion with appropriate restriction enzymes of nucleotide sequences according to the invention, these methods in particular being described in the work of Sambrook et al., 1989. Such representative fragments can likewise be obtained by chemical synthesis according to methods well known to persons of ordinary skill in the art.

Modified nucleotide sequence will be understood as meaning any nucleotide sequence obtained by mutagenesis according to techniques well known to the person skilled in the art, and containing modifications with respect to the normal sequences according to the invention, for example, mutations in the regulatory and/or promoter sequences of polypeptide expression, especially leading to a modification of the rate of expression of the polypeptide or to a modulation of the replicative cycle.

Modified nucleotide sequence will likewise be understood as meaning any nucleotide sequence coding for a modified polypeptide such as defined below.

The present invention relates to nucleotide sequence comprising isolated and/or purified nucleotide sequences of *Alicyclobacillus acidocaldarius*, characterized in that they are selected from the sequences SEQ ID NOS:2, 19, 36, 53, 70, 87, 104, 121, 138, 155, 172, 189, 206, 223, 240, 257, 274, 291, 332, 334, 336, 339, and 340, or one of their fragments.

Embodiments of the invention likewise relate to isolated and/or purified nucleotide sequences characterized in that they comprise a nucleotide sequence selected from: a) at least one of a nucleotide sequence of SEQ ID NOS:2, 19, 36, 53, 70, 87, 104, 121, 138, 155, 172, 189, 206, 223, 240, 257, 274, 291, 332, 334, 336, 339, and 340, or one of their fragments; b) a nucleotide sequence of a specific fragment of a sequence such as defined in a); c) a homologous nucleotide sequence having at least 80% identity with a sequence such as defined in a) or b); d) a complementary nucleotide sequence or sequence of RNA corresponding to a sequence such as defined in a), b) or c); and e) a nucleotide sequence modified by a sequence such as defined in a), b), c) or d).

Among the isolated and/or purified nucleotide sequences according to the invention are the nucleotide sequences of SEQ ID NOS:2, 19, 36, 53, 70, 87, 104, 121, 138, 155, 172, 189, 206, 223, 240, 257, 274, 291, 332, 334, 336, 339, and 340, or fragments thereof and any isolated and/or purified nucleotide sequences which have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with the at least one of the sequences of SEQ ID NOS:2, 19, 36, 53, 70, 87, 104, 121, 138, 155, 172, 189, 206, 223, 240, 257, 274, 291, 332, 334, 336, 339, and 340, or fragments thereof. The homologous sequences can comprise, for example, sequences corresponding to genomic sequences *Alicyclobacillus acidocaldarius*. In the same manner, these specific homologous sequences can correspond to variations linked to mutations within strains of *Alicyclobacillus acidocaldarius* and especially correspond to truncations, substitutions, deletions and/or additions of at least one nucleotide. As will be apparent to one of ordinary skill in the art, such homologues are easily created and identified using standard techniques and publicly available computer programs such as BLAST. As such, each homologue referenced above should be considered as set forth herein and fully described.

Embodiments of the invention comprise the isolated and/or purified polypeptides coded for by a nucleotide sequence according to the invention, or fragments thereof, whose sequence is represented by a fragment. Amino acid sequences corresponding to the isolated and/or purified polypeptides may be coded by one of the three possible reading frames of at least one of the sequences of SEQ ID NOS:2, 19, 36, 53, 70, 87, 104, 121, 138, 155, 172, 189, 206, 223, 240, 257, 274, 291, 332, 334, 336, 339, and 340.

Embodiments of the invention likewise relate to the isolated and/or purified polypeptides, characterized in that they comprise a polypeptide selected from at least one of the amino acid sequences of SEQ ID NOS:1, 18, 35, 52, 69, 86, 103, 120, 137, 154, 171, 188, 205, 222, 239, 256, 273, 290, 307, 331, 333, 335, 337, and 338, or one of their fragments.

Among the isolated and/or purified polypeptides, according to embodiments of the invention, are the isolated and/or purified polypeptides of amino acid sequence SEQ ID NOS: 1, 18, 35, 52, 69, 86, 103, 120, 137, 154, 171, 188, 205, 222, 239, 256, 273, 290, 307, 331, 333, 335, 337, and 338, or fragments thereof or any other isolated and/or purified polypeptides which have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with at least one of the sequences of SEQ ID NOS:1, 18, 35, 52, 69, 86, 103, 120, 137, 154, 171, 188, 205, 222, 239, 256, 273, 290, 307, 331, 333, 335, 337, and 338, or fragments thereof. As will be apparent to one of ordinary skill in the art, such homologues are easily created and identified using standard techniques and publicly available computer programs such as BLAST. As such, each homologue referenced above should be considered as set forth herein and fully described.

Embodiments of the invention also relate to the polypeptides, characterized in that they comprise a polypeptide selected from: a) a specific fragment of at least 5 amino acids of a polypeptide of an amino acid sequence according to the invention; b) a polypeptide homologous to a polypeptide such as defined in a); c) a specific biologically active fragment of a polypeptide such as defined in a) or b); and d) a polypeptide modified by a polypeptide such as defined in a), b) or c).

In the present description, the terms polypeptide, peptide and protein are interchangeable.

In embodiments of the invention, the isolated and/or purified polypeptides according to the invention may be glycosylated, pegylated, and/or otherwise post-translationally modified. In further embodiments, glycosylation, pegylation, and/or other post-translational modifications may occur in vivo or in vitro and/or may be performed using chemical techniques. In additional embodiments, any glycosylation, pegylation and/or other post-translational modifications may be N-linked or O-linked.

In embodiments of the invention, any one of the isolated and/or purified polypeptides according to the invention may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other post-translational modification may be required for the isolated and/or purified polypeptides according to the invention to be enzymatically or functionally active at a pH at or below 8, 7, 6, 5, 4, 3, 2, 1, and/or 0 or at temperatures at or above about 25, 30, 35, 40, 45, 50, 55, 60, 65, 70, 75, 80, 85, 90, and/or 95 degrees Celsius.

Aspects of the invention relate to polypeptides that are isolated or obtained by purification from natural sources, or else obtained by genetic recombination, or alternatively by chemical synthesis and that they may thus contain unnatural amino acids, as will be described below.

A "polypeptide fragment" according to the embodiments of the invention is understood as designating a polypeptide containing at least 5 consecutive amino acids, preferably 10 consecutive amino acids or 15 consecutive amino acids.

In the present invention, a "specific polypeptide fragment" is understood as designating the consecutive polypeptide fragment coded for by a specific fragment of a nucleotide sequence according to the invention.

"Homologous polypeptide" will be understood as designating the polypeptides having, with respect to the natural polypeptide, certain modifications such as, in particular, a deletion, addition, or substitution of at least one amino acid, a truncation, a prolongation, a chimeric fusion, and/or a mutation. Among the homologous polypeptides, those are preferred whose amino acid sequence has at least 80% or 90%, homology with the sequences of amino acids of polypeptides according to the invention.

"Specific homologous polypeptide" will be understood as designating the homologous polypeptides such as defined above and having a specific fragment of a polypeptide according to the invention.

In the case of a substitution, one or more consecutive or nonconsecutive amino acids are replaced by "equivalent" amino acids. The expression "equivalent" amino acid is directed here at designating any amino acid capable of being substituted by one of the amino acids of the base structure without, however, essentially modifying the biological activities of the corresponding peptides and such that they will be defined by the following. As will be apparent to one of ordinary skill in the art, such substitutions are easily created and identified using standard molecular biology techniques and publicly available computer programs such as BLAST. As such, each substitution referenced above should be considered as set forth herein and fully described. These equivalent amino acids may be determined either by depending on their structural homology with the amino acids which they substitute, or on results of comparative tests of biological activity between the different polypeptides, which are capable of being carried out.

By way of nonlimiting example, the possibilities of substitutions capable of being carried out without resulting in an extensive modification of the biological activity of the corresponding modified polypeptides will be mentioned, the replacement, for example, of leucine by valine or isoleucine, of aspartic acid by glutamic acid, of glutamine by asparagine, of arginine by lysine etc., the reverse substitutions naturally being envisageable under the same conditions.

In a further embodiment, substitutions are limited to substitutions in amino acids not conserved among other proteins which have similar identified enzymatic activity. For example, one of ordinary skill in the art may align proteins of the same function in similar organisms and determine which amino acids are generally conserved among proteins of that function. One example of a program that may be used to generate such alignments is available on the Internet at worldwideweb.charite.de/bioinf/strap/in conjunction with the databases provided by the NCBI.

Thus, according to one embodiment of the invention, substitutions or mutations may be made at positions that are generally conserved among proteins of that function. In a further embodiment, nucleic acid sequences may be mutated or substituted such that the amino acid they code for is unchanged (degenerate substitutions and/mutations) and/or mutated or substituted such that any resulting amino acid substitutions or mutations are made at positions that are generally conserved among proteins of that function.

The specific homologous polypeptides likewise correspond to polypeptides coded for by the specific homologous nucleotide sequences such as defined above and, thus, comprise in the present definition the polypeptides that are mutated or correspond to variants which can exist in *Alicyclobacillus acidocaldarius*, and which especially correspond to truncations, substitutions, deletions, and/or additions of at least one amino acid residue.

"Specific biologically active fragment of a polypeptide" according to an embodiment of the invention will be understood in particular as designating a specific polypeptide fragment, such as defined above, having at least one of the characteristics of polypeptides according to the invention. In certain embodiments, the peptide is capable of behaving as at least one of the types of proteins outlined in Table 1.

The polypeptide fragments according to embodiments of the invention, can correspond to isolated or purified fragments naturally present in *Alicyclobacillus acidocaldarius* or correspond to fragments which can be obtained by cleavage of the polypeptide by a proteolytic enzyme, such as trypsin or chymotrypsin or collagenase, or by a chemical reagent, such as cyanogen bromide (CNBr). Such polypeptide fragments can likewise just as easily be prepared by chemical synthesis, from hosts transformed by an expression vector, according to the invention, containing a nucleic acid allowing the expression of the fragments, placed under the control of appropriate regulation and/or expression elements.

"Modified polypeptide" of a polypeptide according to an embodiment of the invention is understood as designating a polypeptide obtained by genetic recombination or by chemical synthesis as will be described below, having at least one modification with respect to the normal sequence. These modifications may or may not be able to bear on amino acids at the origin of specificity, and/or of activity, or at the origin of the structural conformation, localization, and of the capacity of membrane insertion of the polypeptide according to the invention. It will thus be possible to create polypeptides of equivalent, increased, or decreased activity, and of equivalent, narrower, or wider specificity. Among the modified polypeptides, it is necessary to mention the polypeptides in which up to 5 or more amino acids can be modified, truncated at the N- or C-terminal end, or even deleted or added.

The methods allowing the modulations on eukaryotic or prokaryotic cells to be demonstrated are well known to the person of ordinary skill in the art. It is likewise well understood that it will be possible to use the nucleotide sequences coding for the modified polypeptides for the modulations, for example, through vectors according to the invention and described below.

The preceding modified polypeptides can be obtained by using combinatorial chemistry, in which it is possible to systematically vary parts of the polypeptide before testing them on models, cell cultures or microorganisms, for example, to select the compounds that are most active or have the properties sought.

Chemical synthesis likewise has the advantage of being able to use unnatural amino acids, or nonpeptide bonds.

Thus, in order to improve the duration of life of the polypeptides according to the invention, it may be of interest to use unnatural amino acids, for example, in D form, or else amino acid analogs, especially sulfur-containing forms, for example.

Finally, it will be possible to integrate the structure of the polypeptides according to the invention, its specific or modified homologous forms, into chemical structures of polypeptide type or others. Thus, it may be of interest to provide at the N- and C-terminal ends molecules not recognized by proteases.

The nucleotide sequences coding for a polypeptide according to the invention are likewise part of the invention.

The invention likewise relates to nucleotide sequences utilizable as a primer or probe, characterized in that the sequences are selected from the nucleotide sequences according to the invention.

It is well understood that the present invention, in various embodiments, likewise relates to specific polypeptides of *Alicyclobacillus acidocaldarius*, coded for by nucleotide sequences, capable of being obtained by purification from natural polypeptides, by genetic recombination or by chemical synthesis by procedures well known to a person skilled in the art and such as described in particular below. In the same manner, the labeled or unlabeled mono- or polyclonal antibodies directed against the specific polypeptides coded for by the nucleotide sequences are also encompassed by the invention.

Embodiments of the invention additionally relate to the use of a nucleotide sequence according to the invention as a primer or probe for the detection and/or the amplification of nucleic acid sequences.

The nucleotide sequences according to embodiments of the invention can thus be used to amplify nucleotide sequences, especially by the PCR technique (Polymerase Chain Reaction) (Erlich, 1989; Innis et al., 1990; Rolfs et al., 1991; and White et al., 1997).

These oligodeoxyribonucleotide or oligoribonucleotide primers advantageously have a length of at least 8 nucleotides, preferably of at least 12 nucleotides, and even more preferentially at least 20 nucleotides.

Other amplification techniques of the target nucleic acid can be advantageously employed as alternatives to PCR.

The nucleotide sequences of the invention, in particular the primers according to the invention, can likewise be employed in other procedures of amplification of a target nucleic acid, such as: the TAS technique (Transcription-based Amplification System), described by Kwoh et al. in 1989; the 3SR technique (Self-Sustained Sequence Replication), described by Guatelli et al. in 1990; the NASBA technique (Nucleic Acid Sequence Based Amplification), described by Kievitis et al. in 1991; the SDA technique (Strand Displacement Amplification) (Walker et al., 1992); and the TMA technique (Transcription Mediated Amplification).

The polynucleotides of the invention can also be employed in techniques of amplification or of modification of the nucleic acid serving as a probe, such as: the LCR technique (Ligase Chain Reaction), described by Landegren et al. in 1988 and improved by Barany et al. in 1991, which employs a thermostable ligase; the RCR technique (Repair Chain Reaction), described by Segev in 1992; the CPR technique (Cycling Probe Reaction), described by Duck et al. in 1990; the amplification technique with Q-beta replicase, described by Miele et al. in 1983 and especially improved by Chu et al. in 1986, Lizardi et al. in 1988, then by Burg et al., as well as by Stone et al. in 1996.

In the case where the target polynucleotide to be detected is possibly an RNA, for example, an mRNA, it will be possible to use, prior to the employment of an amplification reaction with the aid of at least one primer according to the invention or to the employment of a detection procedure with the aid of at least one probe of the invention, an enzyme of reverse transcriptase type in order to obtain a cDNA from the RNA contained in the biological sample. The cDNA obtained will thus serve as a target for the primer(s) or the probe(s) employed in the amplification or detection procedure according to the invention.

The detection probe will be chosen in such a manner that it hybridizes with the target sequence or the amplicon generated from the target sequence. By way of sequence, such a probe will advantageously have a sequence of at least 12 nucleotides, in particular of at least 20 nucleotides, and preferably of at least 100 nucleotides.

Embodiments of the invention also comprise the nucleotide sequences utilizable as a probe or primer according to the invention, characterized in that they are labeled with a radioactive compound or with a nonradioactive compound.

The unlabeled nucleotide sequences can be used directly as probes or primers, although the sequences are generally labeled with a radioactive isotope (32P, 35S, 3H, 125I) or with a nonradioactive molecule (biotin, acetylaminofluorene, digoxigenin, 5-bromodeoxyuridine, fluorescein) to obtain probes which are utilizable for numerous applications.

Examples of nonradioactive labeling of nucleotide sequences are described, for example, in French Patent No. 7810975 or by Urdea et al. or by Sanchez-Pescador et al. in 1988.

In the latter case, it will also be possible to use one of the labeling methods described in French Patent Appl. Publication Nos. FR-2422956 and FR-2518755.

The hybridization technique can be carried out in various manners (Matthews et al., 1988). The most general method consists in immobilizing the nucleic acid extract of cells on a support (such as nitrocellulose, nylon, polystyrene) and in incubating, under well-defined conditions, the immobilized target nucleic acid with the probe. After hybridization, the excess of the probe is eliminated and the hybrid molecules formed are detected by the appropriate method (measurement of the radioactivity, of the fluorescence or of the enzymatic activity linked to the probe).

The invention, in various embodiments, likewise comprises the nucleotide sequences according to the invention, characterized in that they are immobilized on a support, covalently or noncovalently.

According to another advantageous mode of employing nucleotide sequences according to the invention, the latter can be used immobilized on a support and can thus serve to capture, by specific hybridization, the target nucleic acid obtained from the biological sample to be tested. If necessary, the solid support is separated from the sample and the hybridization complex formed between the capture probe and the target nucleic acid is then detected with the aid of a second probe, a so-called detection probe, labeled with an easily detectable element.

Another aspect of the present invention is a vector for the cloning and/or expression of a sequence, characterized in that it contains a nucleotide sequence according to the invention.

The vectors according to the invention, characterized in that they contain the elements allowing the integration, expression and/or the secretion of the nucleotide sequences in a determined host cell, are likewise part of the invention.

The vector may then contain a promoter, signals of initiation and termination of translation, as well as appropriate regions of regulation of transcription. The vector may be able to be maintained stably in the host cell and can optionally have particular signals specifying the secretion of the translated protein. These different elements may be chosen as a function of the host cell used. To this end, the nucleotide sequences according to the invention may be inserted into autonomous replication vectors within the chosen host, or integrated vectors of the chosen host.

Such vectors will be prepared according to the methods currently used by a person skilled in the art, and it will be possible to introduce the clones resulting therefrom into an appropriate host by standard methods, such as, for example, lipofection, electroporation, and thermal shock.

The vectors according to the invention are, for example, vectors of plasmid or viral origin. One example of a vector for the expression of polypeptides of the invention is baculovirus.

These vectors are useful for transforming host cells in order to clone or to express the nucleotide sequences of the invention.

The invention likewise comprises the host cells transformed by a vector according to the invention.

These cells can be obtained by the introduction into host cells of a nucleotide sequence inserted into a vector such as defined above, then the culturing of the cells under conditions allowing the replication and/or expression of the transfected nucleotide sequence.

The host cell can be selected from prokaryotic or eukaryotic systems, such as, for example, bacterial cells (Olins and Lee, 1993), but likewise yeast cells (Buckholz, 1993), as well as plant cells, such as *Arabidopsis* sp., and animal cells, in particular the cultures of mammalian cells (Edwards and Aruffo, 1993), for example, Chinese hamster ovary (CHO) cells, but likewise the cells of insects in which it is possible to use procedures employing baculoviruses, for example, Sf9 insect cells (Luckow, 1993).

Embodiments of the invention likewise relate to organisms comprising one of the transformed cells according to the invention.

The obtainment of transgenic organisms according to the invention expressing one or more of the genes of *Alicyclobacillus acidocaldarius*, or part of the genes, may be carried out in, for example, rats, mice, or rabbits according to methods well known to a person skilled in the art, such as by viral or nonviral transfections. It will be possible to obtain the transgenic organisms expressing one or more of the genes by transfection of multiple copies of the genes under the control of a strong promoter of ubiquitous nature, or selective for one type of tissue. It will likewise be possible to obtain the transgenic organisms by homologous recombination in embryonic cell strains, transfer of these cell strains to embryos, selection of the affected chimeras at the level of the reproductive lines, and growth of the chimeras.

The transformed cells as well as the transgenic organisms according to the invention are utilizable in procedures for preparation of recombinant polypeptides.

It is today possible to produce recombinant polypeptides in relatively large quantities by genetic engineering using the cells transformed by expression vectors according to the invention or using transgenic organisms according to the invention.

The procedures for preparation of a polypeptide of the invention in recombinant form, characterized in that they employ a vector and/or a cell transformed by a vector according to the invention and/or a transgenic organism comprising one of the transformed cells according to the invention are themselves comprised in the present invention.

As used herein, "transformation" and "transformed" relate to the introduction of nucleic acids into a cell, whether prokaryotic or eukaryotic. Further, "transformation" and "transformed," as used herein, need not relate to growth control or growth deregulation.

Among the procedures for preparation of a polypeptide of the invention in recombinant form, the preparation procedures employing a vector, and/or a cell transformed by the vector and/or a transgenic organism comprising one of the transformed cells, containing a nucleotide sequence according to the invention coding for a polypeptide of *Alicyclobacillus acidocaldarius*.

A variant according to an embodiment of the invention may consist of producing a recombinant polypeptide fused to a "carrier" protein (chimeric protein). The advantage of this system is that it may allow stabilization of and/or a decrease in the proteolysis of the recombinant product, an increase in the solubility in the course of renaturation in vitro and/or a simplification of the purification when the fusion partner has an affinity for a specific ligand.

More particularly, an embodiment of the invention relates to a procedure for preparation of a polypeptide of the invention comprising the following steps: a) culture of transformed cells under conditions allowing the expression of a recombinant polypeptide of nucleotide sequence according to the invention; b) if need be, recovery of the recombinant polypeptide.

When the procedure for preparation of a polypeptide of the invention employs a transgenic organism according to the invention, the recombinant polypeptide is then extracted from the organism.

An embodiment of the invention also relates to a polypeptide which is capable of being obtained by a procedure of the invention such as described previously.

The invention, in another embodiment, also comprises a procedure for preparation of a synthetic polypeptide, characterized in that it uses a sequence of amino acids of polypeptides according to the invention.

A further embodiment of the invention likewise relates to a synthetic polypeptide obtained by a procedure according to the invention.

The polypeptides according to embodiments of the invention can likewise be prepared by techniques which are conventional in the field of the synthesis of peptides. This synthesis can be carried out in a homogeneous solution or in a solid phase.

For example, recourse can be made to the technique of synthesis in a homogeneous solution described by Houben-Weyl in 1974.

This method of synthesis comprises successively condensing, two by two, the successive amino acids in the order required, or in condensing amino acids and fragments formed previously and already containing several amino acids in the appropriate order, or alternatively several fragments previously prepared in this way, it being understood that it will be necessary to protect beforehand all the reactive functions carried by these amino acids or fragments, with the exception of amine functions of one and carboxyls of the other or vice-versa, which must normally be involved in the formation of peptide bonds, especially after activation of the carboxyl function, according to the methods well known in the synthesis of peptides.

Recourse may also be made to the technique described by Merrifield.

To make a peptide chain according to the Merrifield procedure, recourse is made to a very porous polymeric resin, on which is immobilized the first C-terminal amino acid of the chain. This amino acid is immobilized on a resin through its carboxyl group and its amine function is protected. The amino acids that are going to form the peptide chain are thus immobilized, one after the other, on the amino group, which is deprotected beforehand each time, of the portion of the peptide chain already formed, and which is attached to the resin. When the whole of the desired peptide chain has been formed, the protective groups of the different amino acids forming the peptide chain are eliminated and the peptide is detached from the resin with the aid of an acid.

The invention additionally relates to hybrid polypeptides having at least one polypeptide according to the invention, and a sequence of a polypeptide capable of inducing an immune response in man or animals.

Advantageously, the antigenic determinant is such that it is capable of inducing a humoral and/or cellular response.

It will be possible for such a determinant to comprise a polypeptide according to the invention in glycosylated, pegylated, and/or otherwise post-translationally modified form used with a view to obtaining immunogenic compositions capable of inducing the synthesis of antibodies directed against multiple epitopes.

These hybrid molecules can be formed, in part, of a polypeptide carrier molecule or of fragments thereof according to the invention, associated with a possibly immunogenic part, in particular an epitope of the diphtheria toxin, the tetanus toxin, a surface antigen of the hepatitis B virus (French Patent 7921811), the VP1 antigen of the poliomyelitis virus or any other viral or bacterial toxin or antigen.

The procedures for synthesis of hybrid molecules encompass the methods used in genetic engineering for constructing hybrid nucleotide sequences coding for the polypeptide sequences sought. It will be possible, for example, to refer advantageously to the technique for obtainment of genes coding for fusion proteins described by Minton in 1984.

The hybrid nucleotide sequences coding for a hybrid polypeptide, as well as the hybrid polypeptides according to the invention, are so characterized in that they are recombinant polypeptides obtained by the expression of the hybrid nucleotide sequences, which are likewise part of the invention.

The invention likewise comprises the vectors characterized in that they contain one of the hybrid nucleotide sequences. The host cells transformed by the vectors, the transgenic organisms comprising one of the transformed cells as well as the procedures for preparation of recombinant polypeptides using the vectors, the transformed cells and/or the transgenic organisms are, of course, likewise part of the invention.

The polypeptides according to the invention, the antibodies according to the invention described below and the nucleotide sequences according to the invention can advantageously be employed in procedures for the detection and/or identification of *Alicyclobacillus acidocaldarius*, in a sample capable of containing them. These procedures, according to the specificity of the polypeptides, the antibodies and the nucleotide sequences according to the invention which will be used, will in particular be able to detect and/or to identify *Alicyclobacillus acidocaldarius*.

The polypeptides according to the invention can advantageously be employed in a procedure for the detection and/or the identification of *Alicyclobacillus acidocaldarius* in a sample capable of containing them, characterized in that it comprises the following steps: a) contacting of this sample with a polypeptide or one of its fragments according to the invention (under conditions allowing an immunological reaction between the polypeptide and the antibodies possibly present in the biological sample); b) demonstration of the antigen-antibody complexes possibly formed.

Any conventional procedure can be employed for carrying out such a detection of the antigen-antibody complexes possibly formed.

By way of example, a method according to various embodiments brings into play immunoenzymatic processes according to the ELISA technique, by immunofluorescence, or radioimmunological processes (RIA) or their equivalent.

Thus, the invention likewise relates to the polypeptides according to the invention, labeled with the aid of an adequate label, such as, of the enzymatic, fluorescent or radioactive type.

Such methods comprise, for example, the following acts: deposition of determined quantities of a polypeptide composition according to the invention in the wells of a microtiter plate, introduction into the wells of increasing dilutions of serum, or of a biological sample other than that defined previously, having to be analyzed, incubation of the microtiter plate, introduction into the wells of the microtiter plate of labeled antibodies directed against pig immunoglobulins, the labeling of these antibodies having been carried out with the aid of an enzyme selected from those which are capable of hydrolyzing a substrate by modifying the absorption of the radiation of the latter, at least at a determined wavelength, for example, at 550 nm, detection, by comparison with a control test, of the quantity of hydrolyzed substrate.

The polypeptides according to embodiments of the invention enable monoclonal or polyclonal antibodies to be prepared which are characterized in that they specifically recognize the polypeptides according to the invention. It will advantageously be possible to prepare the monoclonal antibodies from hybridomas according to the technique described by Kohler and Milstein in 1975. It will be possible to prepare the polyclonal antibodies, for example, by immunization of an animal, in particular a mouse, with a polypeptide or a DNA, according to the invention, associated with an adjuvant of the immune response, and then purification of the specific antibodies contained in the serum of the immunized animals on an affinity column on which the polypeptide which has served as an antigen has previously been immobilized. The polyclonal antibodies according to the invention can also be prepared by purification, on an affinity column on which a polypeptide according to the invention has previously been immobilized, of the antibodies contained in the serum of an animal immunologically challenged by *Alicyclobacillus acidocaldarius*, or a polypeptide or fragment according to the invention.

The invention, in various embodiments, likewise relates to mono- or polyclonal antibodies or their fragments, or chimeric antibodies, characterized in that they are capable of specifically recognizing a polypeptide according to the invention.

It will likewise be possible for the antibodies of embodiments of the invention to be labeled in the same manner as described previously for the nucleic probes of the invention, such as a labeling of enzymatic, fluorescent or radioactive type.

An embodiment of the invention is additionally directed at a procedure for the detection and/or identification of *Alicyclobacillus acidocaldarius* in a sample, characterized in that it comprises the following steps: a) contacting of the sample with a mono- or polyclonal antibody according to the invention (under conditions allowing an immunological reaction between the antibodies and the polypeptides of *Alicyclobacillus acidocaldarius* possibly present in the biological sample); b) demonstration of the antigen-antibody complex possibly formed.

The present invention likewise relates to a procedure for the detection and/or the identification of *Alicyclobacillus acidocaldarius* in a sample, characterized in that it employs a nucleotide sequence according to the invention.

More particularly, the invention relates to a procedure for the detection and/or the identification of *Alicyclobacillus acidocaldarius* in a sample, characterized in that it contains the following steps: a) if need be, isolation of the DNA from the sample to be analyzed; b) specific amplification of the DNA of the sample with the aid of at least one primer, or a pair of primers, according to the invention; c) demonstration of the amplification products.

These can be detected, for example, by the technique of molecular hybridization utilizing a nucleic probe according to the invention. This probe will advantageously be labeled with a nonradioactive (cold probe) or radioactive isotope.

For the purposes of the present invention, "DNA of the biological sample" or "DNA contained in the biological sample" will be understood as meaning either the DNA present in the biological sample considered, or possibly the cDNA obtained after the action of an enzyme of reverse transcriptase type on the RNA present in the biological sample.

A further embodiment of the invention comprises a method, characterized in that it comprises the following steps: a) contacting of a nucleotide probe according to the invention with a biological sample, the DNA contained in the biological sample having, if need be, previously been made accessible to hybridization under conditions allowing the hybridization of the probe with the DNA of the sample; b) demonstration of the hybrid formed between the nucleotide probe and the DNA of the biological sample.

The present invention also relates to a procedure according to embodiments of the invention, characterized in that it comprises the following steps: a) contacting of a nucleotide probe immobilized on a support according to the invention with a biological sample, the DNA of the sample having, if need be, previously been made accessible to hybridization, under conditions allowing the hybridization of the probe with the DNA of the sample; b) contacting of the hybrid formed between the nucleotide probe immobilized on a support and the DNA contained in the biological sample, if need be after elimination of the DNA of the biological sample which has not hybridized with the probe, with a nucleotide probe labeled according to the invention; c) demonstration of the novel hybrid formed in step b).

According to an advantageous embodiment of the procedure for detection and/or identification defined previously, this is characterized in that, prior to step a), the DNA of the biological sample is first amplified with the aid of at least one primer according to the invention.

Embodiments of methods include glycosylating or post-translationally modifying a first polypeptide using a second polypeptide selected from the group consisting of a polypeptide having at least 90% sequence identity to SEQ ID NOS:1, 18, 35, 52, 69, 86, 103, 120, 137, 154, 171, 188, 205, 222, 239, 256, 273, 290, 307, 331, 333, 335, 337, and 338.

Further embodiments of methods include methods of modulating protein stability, solubility, degradation, activity profile, and/or externalization of a first polypeptide, the methods comprising glycosylating or post-translationally modifying the first polypeptide via a second polypeptide selected from the group consisting of a polypeptide having at least 90% sequence identity to SEQ ID NOS:1, 18, 35, 52, 69, 86, 103, 120, 137, 154, 171, 188, 205, 222, 239, 256, 273, 290, 307, 331, 333, 335, 337 and 338.

Further embodiments of methods include placing a cell producing or encoding a recombinant, purified, and/or isolated nucleotide sequence comprising a nucleotide sequence selected from the group consisting of a nucleotide sequences having at least 90% sequence identity to at least one of the sequences of SEQ ID NOS:2, 19, 36, 53, 70, 87, 104, 121, 138, 155, 172, 189, 206, 223, 240, 257, 274, 291, 332, 334, 336, 339, and 340, and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 331, 333, 335, 337, and 338 in a environment comprising temperatures at or above about 25, 30, 35, 40, 45, 50, 55, 60, 65, 70, 75, 80, 85, 90, and/or 95 degrees Celsius and/or a pH at, below, and/or above 8, 7, 6, 5, 4, 3, 2, 1, and/or 0.

The present invention provides cells that have been genetically manipulated to have an altered capacity to produce expressed proteins. In particular, the present invention relates to Gram-positive microorganisms, such as *Bacillus* species having enhanced expression of a protein of interest, wherein one or more chromosomal genes have been inactivated, and/or wherein one or more chromosomal genes have been deleted from the *Bacillus* chromosome. In some further embodiments, one or more indigenous chromosomal regions have been deleted from a corresponding wild-type *Bacillus* host chromosome. In further embodiments, the *Bacillus* is an *Alicyclobacillus* sp. or *Alicyclobacillus acidocaldarius*.

In additional embodiments, methods of glycosylating and/or post-translationally modifying a polypeptide at temperatures at or above about 25, 30, 35, 40, 45, 50, 55, 60, 65, 70, 75, 80, 85, 90, and/or 95 degrees Celsius and/or at a pH at, below, and/or above 8, 7, 6, 5, 4, 3, 2, 1, and/or 0 via a recombinant, purified, and/or isolated nucleotide sequence comprising a nucleotide sequence selected from the group consisting of a nucleotide sequences having at least 90% sequence identity to at least one of the sequences of SEQ ID NOS:2, 19, 36, 53, 70, 87, 104, 121, 138, 155, 172, 189, 206, 223, 240, 257, 274, 291, 332, 334, 336, 339, and 340, and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 331, 333, 335, 337, and 338.

In embodiments of the invention, any one of the isolated and/or purified polypeptides according to the invention may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other post-translational modification may be required for the isolated and/or purified polypeptides according to the invention to be enzymatically or functionally active at pH at or below 8, 7, 6, 5, 4, 3, 2, 1, and/or 0 or at a temperatures at or above about 25, 30, 35, 40, 45, 50, 55, 60, 65, 70, 75, 80, 85, 90, and/or 95 degrees Celsius.

The invention is described in additional detail in the following illustrative examples. Although the examples may represent only selected embodiments of the invention, it should be understood that the following examples are illustrative and not limiting.

EXAMPLES

Example 1

Glycosylation Using Nucleotide and Amino Acid Sequences from *Alicyclobacillus acidocaldarius*

Provided in SEQ ID NOS:2, 19, 36, 53, 70, 87, 104, 121, 138, 155, 172, 189, 206, 223, 240, 257, 274, 291, 332, 334, 336, 339, and 340 are a nucleotide sequences isolated from *Alicyclobacillus acidocaldarius* and coding for the polypeptides of SEQ ID NOS:1, 18, 35, 52, 69, 86, 103, 120, 137, 154, 171, 188, 205, 222, 239, 256, 273, 290, 307, 331, 333, 335, 337, and 338, respectively. The nucleotide sequences of SEQ ID NOS:2, 19, 36, 53, 70, 87, 104, 121, 138, 155, 172, 189, 206, 223, 240, 257, 274, 291, 332, 334, 336, 339, and 340 are placed into expression vectors using techniques standard in the art. The vectors are then provided to cells such as bacteria cells or eukaryotic cells such as Sf9 cells or CHO cells. In conjunction with the normal machinery in present in the cells, the vectors comprising SEQ ID NOS:2, 19, 36, 53, 70, 87, 104, 121, 138, 155, 172, 189, 206, 223, 240, 257, 274, 291, 332, 334, 336, 339, and 340 produce the polypeptides of SEQ ID NOS:1, 18, 35, 52, 69, 86, 103, 120, 137, 154, 171, 188, 205, 222, 239, 256, 273, 290, 307, 331, 333, 335, 337, and 338. The polypeptides of SEQ ID NOS:1, 18, 35, 52, 69, 86, 103, 120, 137, 154, 171, 188, 205, 222, 239, 256, 273, 290, 307, 331, 333, 335, 337, and 338 are then isolated and/or purified. The isolated and/or purified polypeptides of SEQ ID NOS:1, 18, 35, 52, 69, 86, 103, 120, 137, 154, 171, 188, 205, 222, 239, 256, 273, 290, 307, 331, 333, 335, 337, and 338 are then each demonstrated to have one or more of the activities provided in Table 1 or some other activity.

The isolated and/or purified polypeptides of SEQ ID NOS: 1, 18, 35, 52, 69, 86, 103, 120, 137, 154, 171, 188, 205, 222, 239, 256, 273, 290 are demonstrated to have activity in glycosylating other proteins in conjunction with other proteins or cellular components.

Example 2

Modulating Protein Stability, Solubility, Degradation, Activity Profile, and/or Externalization of a First Polypeptide Using Nucleotide and Amino Acid Sequences from *Alicyclobacillus acidocaldarius*

The polypeptides and nucleotide sequence of Example 1 are used to post-translationally modify one or more other proteins through glycosylation or other post-translational modification. The modified proteins are demonstrated to have altered protein stability, solubility, degradation, activity profile, and/or externalization in comparison to non-modified proteins of the same or similar amino acid sequence.

Example 3

Glycosylated Proteins of *Alicyclobacillus acidocaldarius*

Polypeptide RAAC02676 (SEQ ID NO:307) was obtained via the following protocol. *Alicyclobacillus acidocaldarius* was cultured on wheat arabinoxylan and harvested after three days. The culture was centrifuged to remove cells and the resulting supernatant was filtered with a 0.22 micron filter to remove any remaining debris. The filtered supernatant was concentrated to approximately 1 mL by ultrafiltration through a 10,000 Da molecular weight cutoff membrane. The resulting concentrated filtered supernatant was additionally purified by trapping proteins on a cation exchange column, eluting them with a salt gradient, reloading them on a second cation exchange column and eluting with a second salt gradient. Samples were pooled and run on a 12% SDS-PAGE gel. Individual bands were cut from the gel and subjected to in gel tryptic digestion. The peptide fragments were then eluted and separated on a C-18 column an injected into an ion trap mass spectrometer via electrospray. Mass spectra were run through MASCOT which compares the observed spectra to theoretical spectra generated from the known protein sequence. MASCOT allows the user to specify modifications that might exist on the protein and looks for spectra consistent with these modifications. MASCOT identified a number of peptides digested from RAAC02676 that were potentially glycosylated as provided in Table 2 below.

As can be seen in Table 2, Queries 94, 96, 221, 332, 333, 337, and 400 returned expected N-linked glycosylations on RAAC02676. All fragments in Table 2 are fragments of SEQ ID NO:307 (RAAC02676). O-linked glycosylations are also expected.

TABLE 2

| Query | Observed | Mr(expt) | Mr(calc) | Ppm | Miss | Score | Expect | Rank | Peptide | Amino Acid of SEQ ID NO: 307 |
|---|---|---|---|---|---|---|---|---|---|---|
| 17 | 398.1406 | 794.2667 | 794.4174 | −189.65 | 0 | (24) | 73 | 1 | K.YGDIVTK.N | 823-831 |
| 18 | 398.1591 | 794.3037 | 794.4174 | −143.08 | 0 | (28) | 38 | 2 | K.YGDIVTK.N | 823-831 |
| 19 | 398.1596 | 794.3047 | 794.4174 | −141.82 | 0 | 55 | 0.073 | 1 | K.YGDIVTK.N | 823-831 |
| 20 | 398.1621 | 794.3097 | 794.4174 | −135.53 | 0 | (41) | 1.7 | 1 | K.YGDIVTK.N | 823-831 |
| 77 | 569.1781 | 1136.3417 | 1136.5461 | −179.86 | 0 | (46) | 0.41 | 1 | R.EINAYAGSNAK.N | 491-503 |
| 78 | 569.1796 | 1136.3447 | 1136.5461 | −177.22 | 0 | 62 | 0.011 | 1 | R.EINAYAGSNAK.N | 491-503 |
| 94 | 579.6776 | 1157.3407 | 1157.5676 | −196.02 | 0 | 34 | 6.9 | 1 | R.QNGLSPSDLAR.T + Glyc-Asn (N) | 191-203 (glycosylated at position 193) |
| 96 | 579.7071 | 1157.3997 | 1157.5676 | −145.05 | 0 | (20) | 2.5e+02 | 3 | R.QNGLSPSDLAR.T + Glyc-Asn (N) | 191-203 (glycosylated at position 193) |
| 138 | 721.2386 | 1440.4627 | 1440.7394 | −192.07 | 0 | (62) | 0.019 | 1 | R.EPNGDIALMLVNR.S | 630-644 |
| 139 | 721.2411 | 1440.4677 | 1440.7394 | −188.60 | 0 | 82 | 0.00022 | 1 | R.EPNGDIALMLVNR.S | 630-644 |
| 207 | 987.8796 | 1973.7447 | 1974.0098 | −134.27 | 0 | (130) | 6.2e−09 | 1 | R.AVGLFYQSFLTEIGQSSK.A | 142-161 |
| 208 | 987.8796 | 1973.7447 | 1974.0098 | −134.27 | 0 | (123) | 2.8e−08 | 1 | R.AVGLFYQSFLTEIGQSSK.A | 142-161 |
| 209 | 987.8801 | 1973.7457 | 1974.0098 | −133.76 | 0 | (71) | 0.0045 | 1 | R.AVGLFYQSFLTEIGQSSK.A | 142-161 |
| 210 | 987.8986 | 1973.7827 | 1974.0098 | −115.02 | 0 | 140 | 5.9e−10 | 1 | R.AVGLFYQSFLTEIGQSSK.A | 142-161 |
| 216 | 661.1822 | 1980.5247 | 1980.8966 | −187.71 | 0 | (37) | 4.1 | 1 | R.WPGGSISDVYNWETNTR.N | 286-304 |
| 217 | 991.3196 | 1980.6247 | 1980.8966 | −137.23 | 0 | (59) | 0.053 | 1 | R.WPGGSISDVYNWETNTR.N | 286-304 |
| 218 | 991.3411 | 1980.6677 | 1980.8966 | −115.52 | 0 | (42) | 3.6 | 1 | R.WPGGSISDVYNWETNTR.N | 286-304 |
| 219 | 991.3461 | 1980.6777 | 1980.8966 | −110.47 | 0 | (31) | 40 | 1 | R.WPGGSISDVYNWETNTR.N | 286-304 |
| 221 | 991.8396 | 1981.6647 | 1981.8806 | −108.91 | 0 | 85 | 0.00016 | 1 | R.WPGGSISDVYNWETNTR.N + Glyc-Asn (N) | 286-304 (glycosylated at one of position 297 or position 304) |
| 265 | 731.9392 | 2192.7957 | 2193.2117 | −189.66 | 0 | 69 | 0.0086 | 1 | R.GSNAAQILQTLQSISPLLSPR.A | 121-143 |
| 266 | 1097.4561 | 2192.8977 | 2193.2117 | −143.15 | 0 | (31) | 56 | 1 | R.GSNAAQILQTLQSISPLLSPR.A | 121-143 |
| 286 | 1133.4606 | 2264.9067 | 2265.1892 | −124.70 | 0 | (31) | 58 | 2 | R.SPSTIYSADLNVLGVGPYAITK.A | 643-666 |
| 287 | 1133.4786 | 2264.9427 | 2265.1892 | −108.81 | 0 | (48) | 0.95 | 1 | R.SPSTIYSADLNVLGVGPYAITK.A | 643-666 |
| 288 | 1133.4811 | 2264.9477 | 2265.1892 | −106.60 | 0 | 70 | 0.0073 | 1 | R.SPSTIYSADLNVLGVGPYAITK.A | 643-666 |
| 289 | 756.1595 | 2265.4567 | 2265.1892 | 118 | 0 | (21) | 4.5e+02 | 9 | R.SPSTIYSADLNVLGVGPYAITK.A | 643-666 |
| 309 | 1177.9986 | 2353.9827 | 2354.2481 | −112.72 | 0 | 68 | 0.012 | 1 | K.ALVYGEGSSAVSPALTLPTAHSVK.L | 665-690 |
| 310 | 1178.0016 | 2353.9887 | 2354.2481 | −110.17 | 0 | (51) | 0.59 | 1 | K.ALVYGEGSSAVSPALTLPTAHSVK.L | 665-690 |
| 311 | 1178.0086 | 2354.0027 | 2354.2481 | −104.22 | 0 | (54) | 0.26 | 1 | K.ALVYGEGSSAVSPALTLPTAHSVK.L | 665-690 |
| 319 | 1182.9381 | 2363.8617 | 2364.1346 | −115.41 | 0 | (91) | 5.1e−05 | 1 | R.TWSSFETQVDPQGAAQTALATR.I | 202-225 |
| 320 | 1182.9386 | 2363.8627 | 2364.1346 | −114.99 | 0 | (109) | 7.9e−07 | 1 | R.TWSSFETQVDPQGAAQTALATR.I | 202-225 |
| 321 | 1182.9416 | 2363.8687 | 2364.1346 | −112.45 | 0 | (115) | 2.1e−07 | 1 | R.TWSSFETQVDPQGAAQTALATR.I | 202-225 |
| 322 | 1182.9781 | 2363.9417 | 2364.1346 | −81.57 | 0 | (83) | 0.00036 | 1 | R.TWSSFETQVDPQGAAQTALATR.I | 202-225 |
| 323 | 1182.9866 | 2363.9587 | 2364.1346 | −74.38 | 0 | 126 | 1.6e−08 | 1 | R.TWSSFETQVDPQGAAQTALATR.I | 202-225 |
| 324 | 789.1825 | 2364.5257 | 2364.1346 | 165 | 0 | (17) | 1.1e+03 | 9 | R.TWSSFETQVDPQGAAQTALATR.I | 202-225 |
| 307 | 1188.3281 | 2374.6417 | 2374.1851 | 192 | 0 | 88 | 7.6e−05 | 1 | K.GNPGLSPQAYAQNALQFIQAMR.A | 391-414 |
| 332 | 1188.4176 | 2374.8207 | 2375.1691 | −146.69 | 0 | (72) | 0.0042 | 1 | K.GNPGLSPQAYAQNALQFIQAMR.A + Glyc-Asn (N) | 391-414 (glycosylated at position 404) |
| 333 | 1188.4181 | 2374.8217 | 2375.1691 | −146.26 | 0 | (76) | 0.0019 | 1 | K.GNPGLSPQAYAQNALQFIQAMR.A + Glyc-Asn (N) | 391-414 (glycosylated at position 393) |
| 337 | 1188.9406 | 2375.8667 | 2376.1531 | −120.54 | 0 | (66) | 0.017 | 1 | K.GNPGLSPQAYAQNALQFIQAMR.A + 2 Glyc-Asn (N) | 391-414 (glycosylated at on of position 393 or position 404) |
| 397 | 1288.5416 | 2575.0687 | 2575.3605 | −113.30 | 0 | (130) | 8.2e−09 | 1 | R.QASSSIVGNALAQAASLSPTISAYLR.Q | 165-192 |
| 398 | 1288.5621 | 2575.1097 | 2575.3605 | −97.38 | 0 | 135 | 2.6e−09 | 1 | R.QASSSIVGNALAQAASLSPTISAYLR.Q | 165-192 |
| 399 | 859.5002 | 2575.4787 | 2575.3605 | 45.9 | 0 | (64) | 0.034 | 1 | R.QASSSIVGNALAQAASLSPTISAYLR.Q | 165-192 |
| 400 | 859.8579 | 2576.5517 | 2576.3445 | 80.4 | 0 | (74) | 0.0035 | 1 | R.QASSSIVGNALAQAASLSPTISAYLR.Q + Glyc-Asn (N) | 165-192 (glycosylated at position 174) |

Example 4

Glycoprotein Staining of Proteins from *Alicyclobacillus acidocaldarius*

*Alicyclobacillus acidocaldarius* was cultured on wheat arabinoxylan and harvested after three days. The culture was centrifuged to remove cells and the resulting supernatant was filtered with a 0.22 micron filter to remove any remaining debris. The filtered supernatant was concentrated to approximately 1 mL by ultrafiltration through a 10,000 Da molecular weight cutoff membrane. Several lanes of this concentrated material were run on a 12% SDS-PAGE gel along with a positive and negative control that are known glycosylated and non-glycosylated proteins using standard protocols. The gel was cut in half vertically and one half stained using SIMPLYBLUE™ SAFESTAIN and the other half using a glycoprotein detection kit from Sigma. The positive and negative controls both stained using the SIMPLYBLUE™ SAFESTAIN and only the positive control stained with the glycoprotein stain indicating that the staining protocol was working correctly. The *Alicyclobacillus acidocaldarius* protein lanes revealed a band at approximately 120 kDa on the SIMPLYBLUE™ stained gel which is the expected weight of one extracelluar protein of *Alicyclobacillus acidocaldarius*. The same position on the glycoprotein stained gel showed pink bands indicating a positive result for a glycosylated protein.

Example 5

Chemical Glycosylation of SEQ ID NO:307 Results in Greater Xylanase Activity SEQ ID NO:307 was expressed in *E. coli* and purified using a Co-resin system. The nucleic acid encoding SEQ ID NO:307 was altered for optimal codon usage in *E. coli*. The purified SEQ ID NO:307 was chemically glycosylated using a mono(lactosylamido) mono(succinimidyl)suberate. This chemically reacts with amine groups on proteins to form an N-linked modification with a terminal lactose on the protein The glycosylation of the purified SEQ ID NO:307 was verified using a glycosylation stain. Purified glycosylated and un-glycosylated SEQ ID NO:307 was tested for xylanase activity at pHs 2, 3.5, and 5. The glycosylated SEQ ID NO:307 had higher levels of activity at pH 2 and 3.5 that the ungylcosylated from of SEQ ID NO:307. Un-glycosylated SEQ ID NO:307 displayed reduced solubility at pH 2 and 3.5.

Example 6

Expression of SEQ ID NO:307 in *Pichia pastoris*

Nucleic acid encoding SEQ ID NO:307 was inserted into *Pichia pastoris* and several clones had significant xylanase and cellulose activities at pH 3.5, but not at pH 2. The nucleic acid encoding SEQ ID NO:307 was altered for optimal codon usage in *Pichia pastoris*.

Example 7

Comparison of Xylanase and Cellulase Activity of SEQ ID NO:307 Expressed in *Alicyclobacillus acidocaldarius* and *E. coli*

Figure 23:
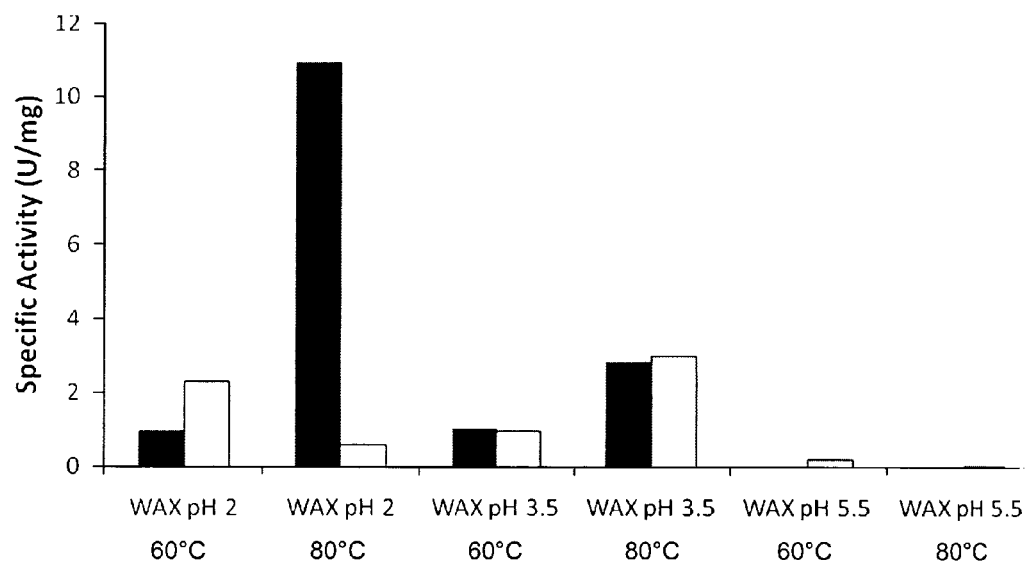
FIG. 23 is a graph depicting xylanase activity of SEQ ID NO:307 as determined using Wheat arabinoxylan (WAX) at various pH and temperature levels. The enzyme was isolated from *Alicyclobacillus acidocaldarius* (black bars) or produced in *E. coli* (white bars). There is no available data for enzyme isolated from *Alicyclobacillus acidocaldarius* at pH 5.5 (60° C. and 80° C.).

Nucleic acid encoding SEQ ID NO:307 was inserted into *E. coli* with an N-terminal His tag and the resultant protein purified. The nucleic acid encoding SEQ ID NO:307 was altered for optimal codon usage in *E. coli*. The resulting purified protein had no glycosylation. Protein of SEQ ID NO:307 was also purified from *Alicyclobacillus acidocaldarius*. The purified protein from *Alicyclobacillus acidocaldarius* was glycosylated as normal for protein produced from this organism. The purified proteins were tested for xylanase activity using wheat arabinoxylan (WAX). The results of the comparison are presented in FIG. 23. There was no data available for enzyme purified from *Alicyclobacillus acidocaldarius* at pH 5.5. As can be seen in FIG. 23, the *Alicyclobacillus acidocaldarius* purified enzyme (black bars) had significantly more xylanase activity at pH 2 and 80° C. than the *E. coli* purified enzyme (white bars).

Figure 24:
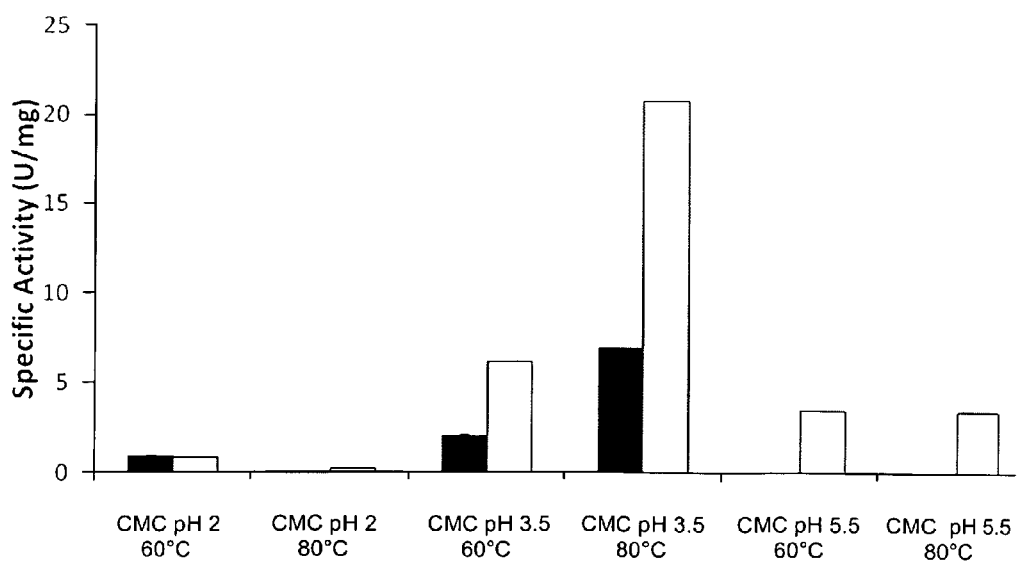
FIG. 24 is a graph depicting cellulase activity of SEQ ID NO:307 as determined using carboxymethyl cellulose (CMC) at various pH and temperature levels. The enzyme was isolated from *Alicyclobacillus acidocaldarius* (black bars) or produced in *E. coli* (white bars). There is no available data for enzyme isolated from *Alicyclobacillus acidocaldarius* at pH 5.5 (60° C. and 80° C.).

The purified proteins were also tested for cellulase activity using carboxymethyl cellulose (CMC). The results of the comparison are presented in FIG. 24. There was no data available for enzyme purified from *Alicyclobacillus acidocaldarius* at pH 5.5. As can be seen in FIG. 24, the *Alicyclobacillus acidocaldarius* purified enzyme (black bars) had significantly less cellulase activity at pH 3.5 than the *E. coli* purified enzyme (white bars).

Figure 25:
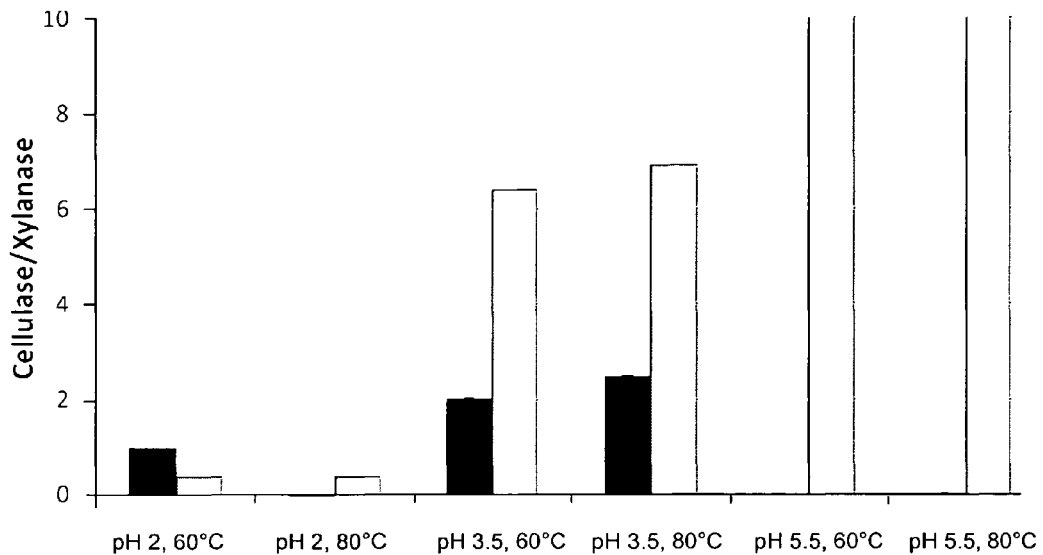
FIG. 25 is a graph depicting a ratio of cellulose/xylanase activity of SEQ ID NO:307 as determined from FIGS. 23 and 24 at various pH and temperature levels. The enzyme was isolated from *Alicyclobacillus acidocaldarius* (black bars) or produced in *E. coli* (white bars). There is no available data for enzyme isolated from *Alicyclobacillus acidocaldarius* at pH 5.5 (60° C. and 80° C.). The tops of the bars at pH 5.5 for the enzyme produced in *E. coli* are left open to indicate that the ratio was greater than 10.

FIG. 25 presents the ratio of cellulose/xylanase activity for the data presented in FIGS. 23 and 24. As can be seen therein, enzyme purified from *Alicyclobacillus acidocaldarius* had predominantly xylanase activity at pH 2 and 80° C., while having predominantly cellulose activity at all other conditions tested (black bars). The enzyme purified from *E. coli* had predominantly cellulose activity at all conditions tested (white bars). This data confirms that the glycosylation state of SEQ ID NO:307 varies the relative xylanase and cellulose activities of SEQ ID NO:307.

Example 8

Comparison of Xylanase and Cellulase Activity of SEQ ID NO:307 Expressed in *E. coli* and *Pichia pastoris*

Figure 26:
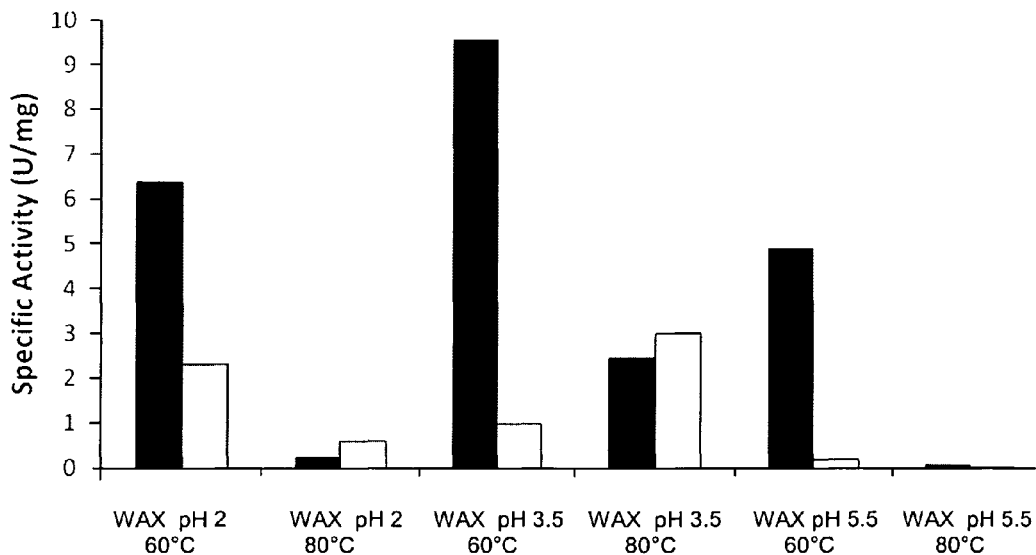
FIG. 26 is a graph depicting xylanase activity of SEQ ID NO:307 as determined using wheat arabinoxylan (WAX) at various pH and temperature levels. The enzyme was produced in *Pichia pastoris* (black bars) or produced in *E. coli* (white bars).

Nucleic acid encoding SEQ ID NO:307 was inserted into *Pichia pastoris* and the resultant protein purified. The nucleic acid encoding SEQ ID NO:307 was altered for optimal codon usage in *Pichia pastoris*. The purified protein from *Pichia pastoris* was glycosylated as normal for protein produced from this organism. Nucleic acid encoding SEQ ID NO:307 was inserted into *E. coli* with an N-terminal His tag and the resultant protein purified. The nucleic acid encoding SEQ ID NO:307 was altered for optimal codon usage in *E. coli*. The resulting purified protein had no glycosylation. The purified proteins were tested for xylanase activity using wheat arabinoxylan. The results of the comparison are presented in FIG. 26. As can be seen in FIG. 26, the *Pichia pastoris* purified enzyme (black bars) had significantly more xylanase activity at all conditions other than pH 3.5 and 80° C. than the *E. coli* purified enzyme (white bars).

Figure 27:
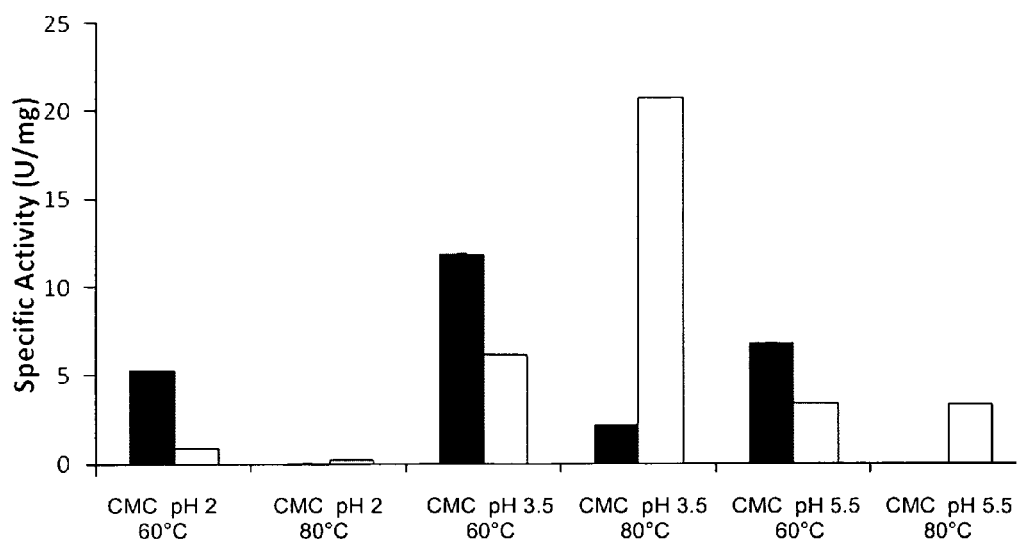
FIG. 27 is a graph depicting cellulase activity of SEQ ID NO:307 as determined using carboxymethyl cellulose (CMC) at various pH and temperature levels. The enzyme was produced in *Pichia pastoris* (black bars) or produced in *E. coli* (white bars).

The purified proteins were also tested for cellulase activity using carboxymethyl cellulose. The results of the comparison are presented in FIG. 27. As can be seen in FIG. 27, the *Pichia pastoris* purified enzyme (black bars) had significantly greater cellulase activity at 60° C. while the *E. coli* purified enzyme (white bars) displayed significantly greater cellulase activity at 80° C.

Figure 28:
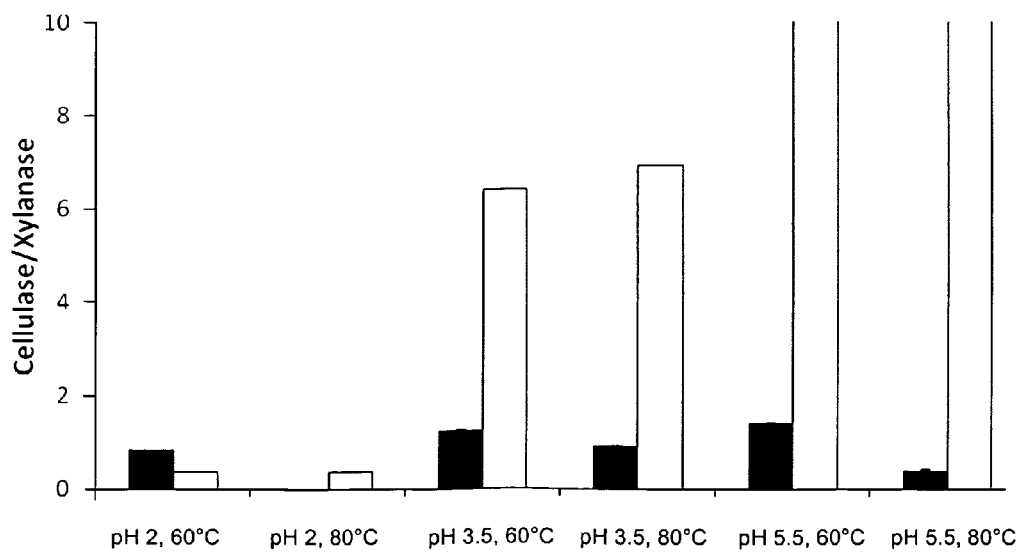
FIG. 28 is a graph depicting a ratio of cellulose/xylanase activity of SEQ ID NO:307 as determined from FIGS. 26 and 27 at various pH and temperature levels. The enzyme was produced in *Pichia pastoris* (black bars) or produced in *E. coli* (white bars). The tops of the bars at pH 5.5 for the enzyme produced in *E. coli* are left open to indicate that the ratio was greater than 10.

FIG. 28 presents the ratio of cellulose/xylanase activity for the data presented in FIGS. 26 and 27. As can be seen therein, enzyme purified from *Pichia pastoris* had predominantly cellulase activity at all conditions other than pH 2 and 80° C. The enzyme purified from *E. coli* had predominantly cellulose activity at all conditions tested. This data confirms that the glycosylation state of SEQ ID NO:307 varies the relative xylanase and cellulose activities of SEQ ID NO:307.

Example 9

Comparison of Xylanase and Cellulase Activity of SEQ ID NO:307 Expressed in *Alicyclobacillus acidocaldarius* and *Pichia pastoris*

Figure 29:
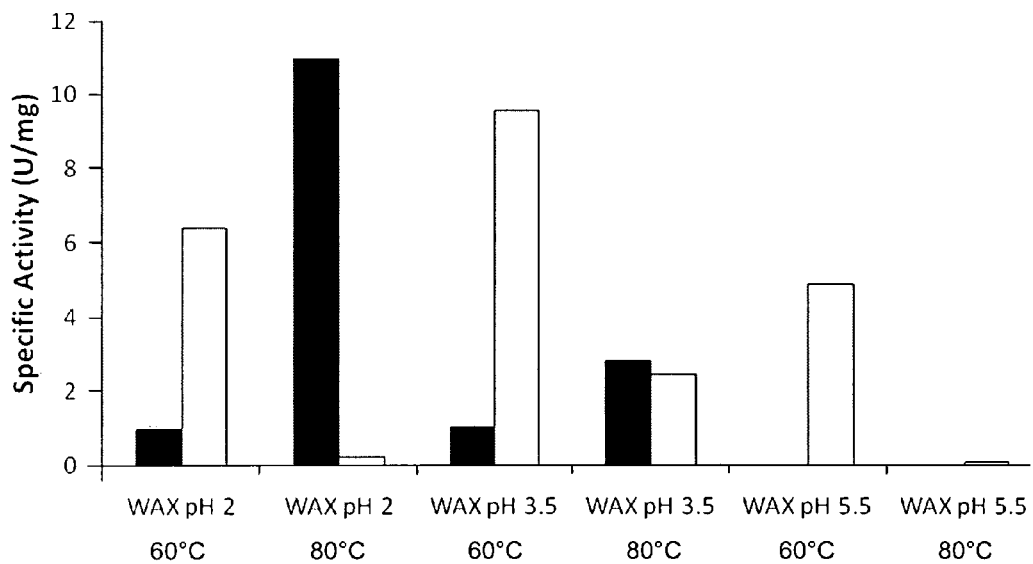
FIG. 29 is a graph depicting xylanase activity of SEQ ID NO:307 as determined using wheat arabinoxylan (WAX) at various pH and temperature levels. The enzyme was isolated from *Alicyclobacillus acidocaldarius* (black bars) or produced in *Pichia pastoris* (white bars). There is no available data for enzyme isolated from *Alicyclobacillus acidocaldarius* at pH 5.5 (60° C. and 80° C.).

Nucleic acid encoding SEQ ID NO:307 was inserted into *Pichia pastoris* and the resultant protein purified. The nucleic acid encoding SEQ ID NO:307 was altered for optimal codon usage in *Pichia pastoris*. The purified protein from *Pichia pastoris* was glycosylated as normal for protein produced from this organism. Protein of SEQ ID NO:307 was also purified from *Alicyclobacillus acidocaldarius*. The purified protein from *Alicyclobacillus acidocaldarius* was glycosylated as normal for protein produced from this organism. The purified proteins were tested for xylanase activity using wheat arabinoxylan. The results of the comparison are presented in FIG. 29. There was no data available for enzyme purified from *Alicyclobacillus acidocaldarius* at pH 5.5. As can be seen in FIG. 29, the *Alicyclobacillus acidocaldarius* purified enzyme (black bars) had significantly more xylanase activity at a pH of 2 and a pH of 3.5 and 80° C. than the *Pichia pastoris* purified enzyme (white bars).

Figure 30:
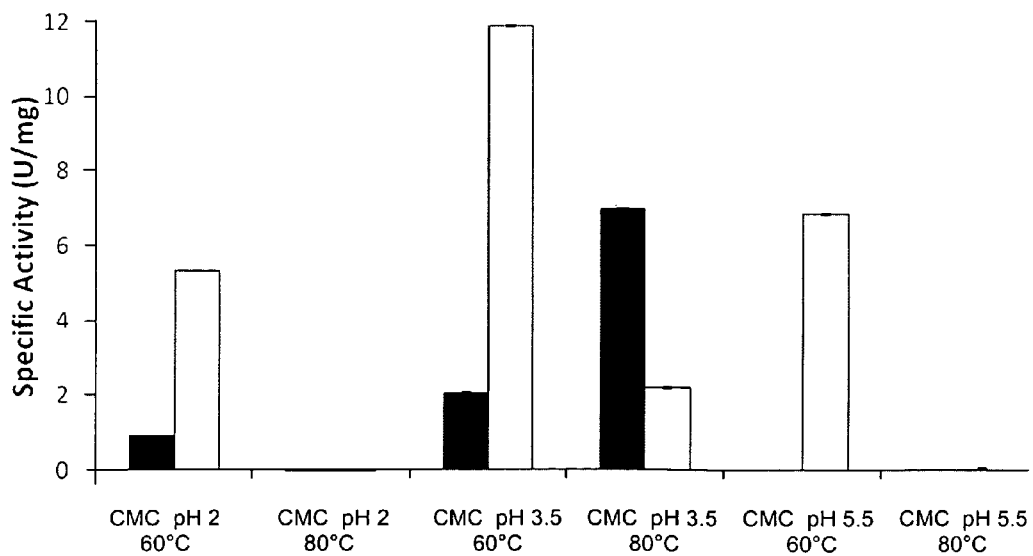
FIG. 30 is a graph depicting cellulase activity of SEQ ID NO:307 as determined using carboxymethyl cellulose (CMC) at various pH and temperature levels. The enzyme was isolated from *Alicyclobacillus acidocaldarius* (black bars) or produced in *Pichia pastoris* (white bars). There is no available data for enzyme isolated from *Alicyclobacillus acidocaldarius* at pH 5.5 (60° C. and 80° C.).

The purified proteins were also tested for cellulase activity using carboxymethyl cellulose. The results of the comparison are presented in FIG. 30. There was no data available for enzyme purified from *Alicyclobacillus acidocaldarius* at pH 5.5. As can be seen in FIG. 30, the *Alicyclobacillus acidocaldarius* purified enzyme (black bars) had significantly less cellulase activity at all conditions other than pH 3.5 and 80° C. than the *Pichia pastoris* purified enzyme (white bars).

Figure 31:
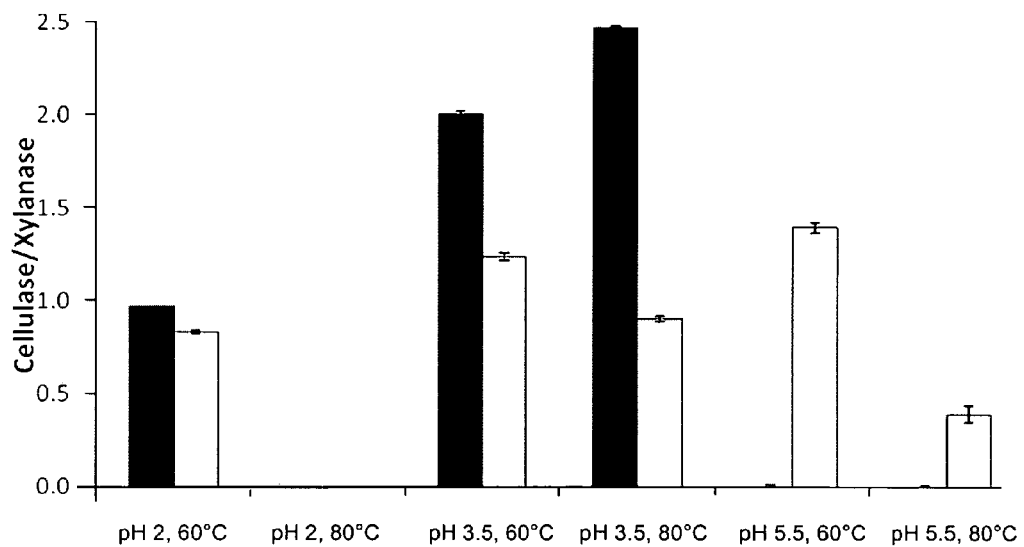
FIG. 31 is a graph depicting a ratio of cellulose/xylanase activity of SEQ ID NO:307 as determined from FIGS. 29 and 30 at various pH and temperature levels. The enzyme was isolated from *Alicyclobacillus acidocaldarius* (black bars) or produced in *Pichia pastoris* (white bars). There is no available data for enzyme isolated from *Alicyclobacillus acidocaldarius* at pH 5.5 (60° C. and 80° C.).

FIG. 31 presents the ratio of cellulose/xylanase activity for the data presented in FIGS. 29 and 30. As can be seen therein, enzyme purified from *Alicyclobacillus acidocaldarius* had predominantly xylanase activity at pH 2 and 80° C., while having predominantly cellulose activity at all other conditions tested (black bars). The enzyme purified from *Pichia pastoris* also had predominantly xylanase activity at pH 2 and 80° C., while having predominantly cellulase activity at all other conditions tested (white bars). This data confirms that the glycosylation state of SEQ ID NO:307 varies the relative xylanase and cellulose activities of SEQ ID NO:307.

Example 10

Comparison of Xylanase and Cellulase Activity of Truncated SEQ ID NO:307 Expressed in *E. coli* and *Pichia pastoris*

Nucleic acid encoding a truncated SEQ ID NO:307 without the 203 C-terminal amino acids was inserted into *Pichia pastoris* with a C-terminal His tag and the resultant protein purified. The nucleic acid encoding SEQ ID NO:307 was altered for optimal codon usage in *Pichia pastoris*. The purified protein from *Pichia pastoris* was glycosylated as normal for protein produced from this organism. Nucleic acid encoding a truncated SEQ ID NO:307 without the 203 C-terminal amino acids and N-terminal 33 leader sequence amino acids were inserted into *E. coli* with an and the resultant protein purified. The nucleic acid encoding SEQ ID NO:307 was altered for optimal codon usage in *E. coli*. The resulting purified protein had no glycosylation. The purified proteins were tested for xylanase activity using wheat arabinoxylan.

Figure 32:
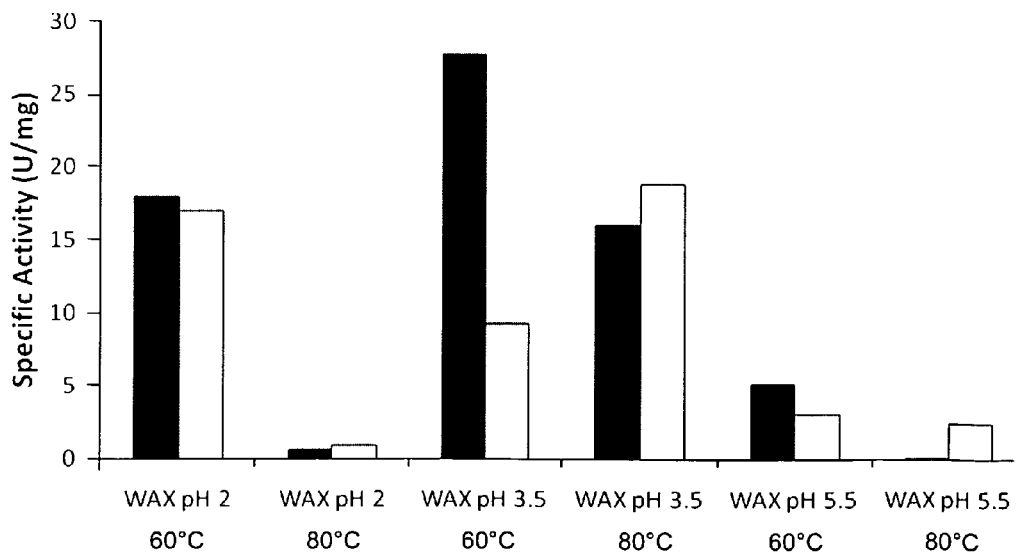
FIG. 32 is a graph depicting xylanase activity of SEQ ID NO:307 lacking the C-terminal 203 amino acids as determined using wheat arabinoxylan (WAX) at various pH and temperature levels. The enzyme was produced in *Pichia pastoris* (black bars) or produced in *E. coli* (white bars).

The results of the comparison are presented in FIG. 32. As can be seen in FIG. 32, the *Pichia pastoris* purified enzyme (black bars) had significantly more xylanase activity at all 60° C. conditions while the *E. coli* purified enzyme (white bars) had more xylanase activity at all 80° C. conditions.

Figure 33:
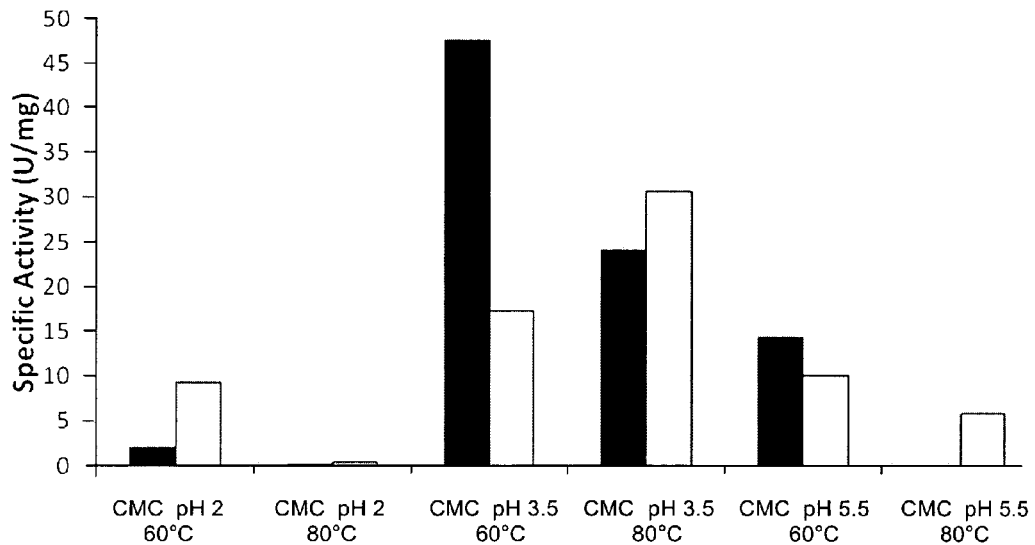
FIG. 33 is a graph depicting cellulase activity of SEQ ID NO:307 lacking the C-terminal 203 amino acids as determined using carboxymethyl cellulose (CMC) at various pH and temperature levels. The enzyme was produced in *Pichia pastoris* (black bars) or produced in *E. coli* with an N-terminal His tag (white bars).

The purified proteins were also tested for cellulase activity using carboxymethyl cellulose. The results of the comparison are presented in FIG. 33. As can be seen in FIG. 33, the *Pichia pastoris* purified enzyme (black bars) had significantly greater cellulase activity 60° C. and pHs 3.5 and 5.5 while the *E. coli* purified enzyme (white bars) displayed greater cellulase at all other conditions.

Figure 34:
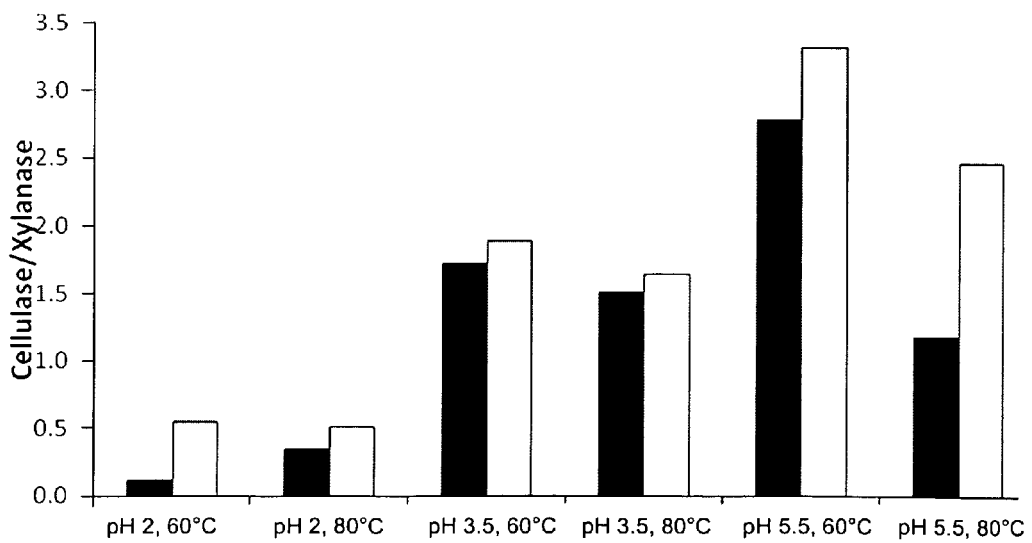
FIG. 34 is a graph depicting a ratio of cellulose/xylanase activity of SEQ ID NO:307 lacking the C-terminal 203 amino acids as determined from FIGS. 32 and 33 at various pH and temperature levels. The enzyme was produced in *Pichia pastoris* (black bars) or produced in *E. coli* (white bars).

FIG. 34 presents the ratio of cellulose/xylanase activity for the data presented in FIGS. 32 and 33. As can be seen therein, both purified enzymes had predominantly cellulase activity at all conditions.

Example 11

Activity of SEQ ID NO:338 Expressed in *E. coli* and *Pichia pastoris*

RAAC00568 (SEQ ID NO:338) was expressed in both *E. coli* and *Pichia pastoris*. Codon usage in the encoding DNA was optimized for the particular organism. In *E. coli*, the enzyme expressed primarily as inclusion bodies. A small amount of enzyme was soluble and we were able to purify it via the His tag by immobilized metal affinity chromatography (IMAC). This purified enzyme was tested for both alpha glucosidase and alpha xylosidase activities at pH 6.0 and 60° C. and was found to have no activity. Several attempts were also made to solubilize the inclusion bodies and did not result in active protein. In *Pichia pastoris*, a soluble enzyme was expressed and purified by IMAC. This enzyme had activity at pH 5.5 and 60° C. for both alpha glucosidase and alpha xylosidase. These results demonstrate that the expression system and glycosylation state of RAAC00568 may alter both the solubility and activity of the enzyme.

Example 12

Activity of SEQ ID NO:337 Expressed in *E. coli* and *Pichia pastoris*

RAAC00307 (SEQ ID NO:337) was expressed in both *E. coli* and *Pichia pastoris*. Codon usage in the encoding DNA was optimized for the particular organism. The *E. coli* produced enzyme was purified via a His tag by immobilized metal affinity chromatography (IMAC). This purified enzyme was tested for both alpha arabinofuranosidase (AFS) activity, as well as beta xylosidase (BXYL) activity. The results of this testing are presented in FIGS. 35-37. In *Pichia pastoris*, a soluble enzyme was expressed and purified by IMAC.

Figure 35:
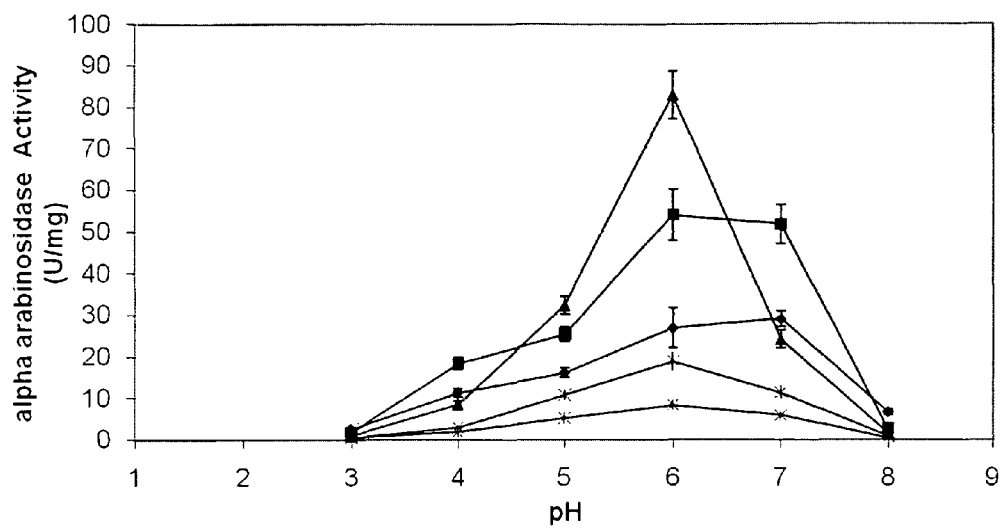
FIG. 35 is a graph depicting a ratio of arabinofuranosidase activity of RAAC00307 (SEQ ID NO:337) produced in *E. coli*. Activity at 50° C. (diamonds), 60° C. (squares), 70° C. (triangles), 80° C. ("x"s), and 90° C. ("*"s) at various pH levels are shown. The enzyme had no activity at pH 2.
Figure 36:
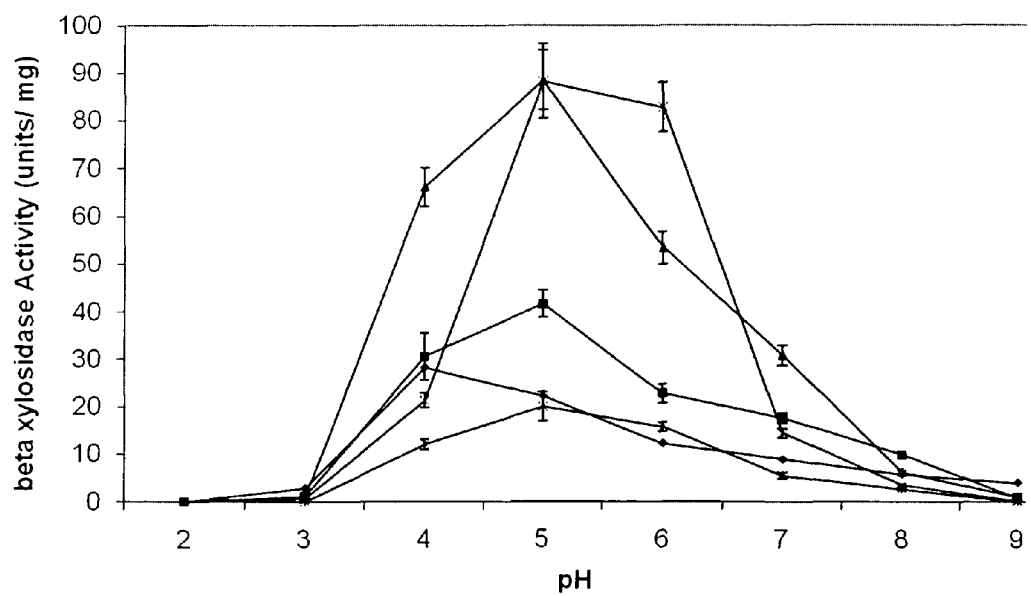
FIG. 36 is a graph depicting a ratio of beta xylosidase activity of RAAC00307 (SEQ ID NO:337) produced in *E. coli*. Activity at 50° C. (diamonds), 60° C. (squares), 70° C. (triangles), 80° C. ("x"s), and 90° C. ("*"s) at various pH levels are shown. The enzyme had no activity at pH 2.
Figure 37:
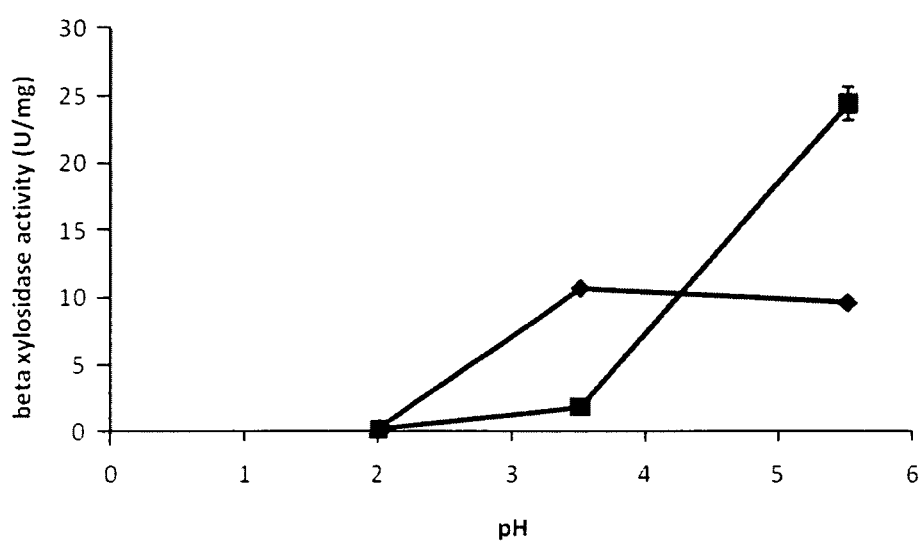
FIG. 37 is a graph depicting a ratio of beta xylosidase activity of RAAC00307 (SEQ ID NO:337) produced in *Pichia pastoris*. Activity at 60° C. (diamonds) and 80° C. (squares), at various pH levels are shown.

The optimum conditions for the *E. coli* expressed AFS were pH 6.0 and 70° C., while the optimum conditions for BXYL were pH 5.0 and between 70° C. and 80° C. (FIGS. 35 and 36). The enzyme did not have activity at pH 2.0 for either AFS or BXYL activities (FIGS. 35 and 36). The *Pichia pastoris* expressed enzyme was screened at pH 2, 3.5, and 5.5 and at 60° C. and 80° C. The results are presented in FIG. 37. The glycosylation modifications made by *Pichia pastoris* during expression appeared to have shifted the activity to a lower pH. The BXYL in the *Pichia pastoris* expressed enzyme was 10.8 U/mg at pH 3.0, 60° C., while it was only 1.1 U/mg for the *E. coli* expressed enzyme. The *Pichia pastoris* expressed enzyme also had some activity at pH 2.0 while there was no activity for the *E. coli* expressed enzyme. These results demonstrate that the expression system and glycosylation state of RAAC00307 may alter its activity.

All references, including publications, patents, and patent applications, cited herein are hereby incorporated by reference to the same extent as if each reference were individually and specifically indicated to be incorporated by reference and were set forth in its entirety herein.

While this invention has been described in the context of certain embodiments, the present invention can be further modified within the spirit and scope of this disclosure. This application is therefore intended to cover any variations, uses, or adaptations of the invention using its general principles. Further, this application is intended to cover such departures from the present disclosure as come within known or customary practice in the art to which this invention pertains and which fall within the limits of the appended claims and their legal equivalents.

BIBLIOGRAPHIC REFERENCES

Barany, F., 1991, *PNAS, USA* 88:189-193.
Borman, S., 2006, Glycosylation Engineering, *Chem. Eng. News* 84(36):13-22.
Buckholz, R. G., 1993, Yeast Systems for the Expression of Heterologous Gene Products, *Curr. Op. Biotechnology* 4:538-542.
Burg, J. L. et al., 1996, *Mol. and Cell. Probes* 10:257-271.
Chu, B. C. F. et al., 1986, *NAR* 14:5591-5603.
Duck, P. et al., 1990, *Biotechniques* 9:142-147.
Edwards, C. P., and Aruffo, A., 1993, Current Applications of COS Cell-Based Transient Expression Systems, *Curr. Op. Biotechnology* 4:558-563.
Guateli, J. C. et al., 1990, *PNAS, USA* 87:1874-1878.
Houben-Weyl, 1974, in *Methode der Organischen Chemie*, E. Wunsch Ed., Volumes 15-I and 15-II, Thieme, Stuttgart.
Innis, M. A. et al., 1990, in *PCR Protocols. A Guide to Methods and Applications*, San Diego, Academic Press.
Kievitis, T. et al., 1991, *J. Virol. Methods* 35:273-286.
Kohler, G. et al., 1975, *Nature* 256(5517):495-497.
Kwoh, D. Y. et al., 1989, *PNAS, USA* 86:1173-1177.
Luckow, V. A., 1993, *Baculovirus* Systems for the Expression of Human Gene Products, *Curr. Op. Biotechnology* 4:564-572.
Matthews, J. A. et al., 1988, *Analyt. Biochem.* 169:1-25.
Merrifield, R. D., 1966, *J. m. Chem. Soc.* 88(21):5051-5052.
Miele, E. A. et al., 1983, *J. Mol. Biol.* 171:281-295.
Olins, P. O., and Lee, S. C., 1993, Recent Advances in Heterologous Gene Expression in *E. coli*, *Curr. Op. Biotechnology* 4:520-525.
Rolfs, A. et al., 1991, In *PCR Topics. Usage of Polymerase Chain Reaction in Genetic and Infectious Disease*, Berlin: Springer-Verlag.
Sambrook, J. et al., 1989, In *Molecular Cloning: A Laboratory Manual*, Cold Spring Harbor, N.Y.: Cold Spring Harbor Laboratory Press.
Sanchez-Pescador, R., 1988, *J. Clin. Microbiol.* 26(10):1934-1938.
Segev, D., 1992, in *Non-Radioactive Labeling and Detection of Biomolecules*, Kessler C., Springer-Verlag, Berlin, New York: 197-205.
Schäffer, C. et al., 2001, Prokaryotic Glycosylation, *Proteomics* 1:248-261.
Schwermann, B. et al., 1994, Purification, Properties and Structural Aspects of a Thermoacidophilic α-Amylase From *Alicyclobacillus acidocaldarius* ATCC 27009, Insight Into Acidostability of Proteins, *Eur. J. Biochem.* 226:981-991.
Upreti et al., 2003, Bacterial Glycoproteins: Functions, Biosynthesis and Applications, *Proteomics* 3:363-379.
Urdea, M. S., 1988, *Nucleic Acids Research II:*4937-4957.
Walker, G. T. et al., 1992, *NAR* 20:1691-1696.
Walker, G. T. et al., 1992, *PNAS, USA* 89:392-396.
White, B. A. et al., 1997, *Methods in Molecular Biology* 67, Humana Press, Totowa, N.J.

SEQUENCE LISTING (340 sequences)

SEQ ID NO: 1 - protein, 385 aa, Alicyclobacillus acidocaldarius
MSMRIAMFTETFLPSTDGIVTRLCATLKYLEREGHEVLLFAPSGSPETYASATIVGIPAMPFILYPEKRYSLPLPRIGKHLRAFRPDLIHVVNPAFLGIGGIYYAWKSHLPLVASYHTNVPAYARHYKLEFLEPLLWWYFRTLHNRAHLNLATSRATLRELERQGFQNLELWERGVDVELFRNAPYSEEMRRRLAPEAKPGDRVLLYVGRLASEKNIERMRPVLDAIPDLHLAIVGDGPHRPELERVFAGTRTHFTGYLHGEELAQAYRAADAFLFPSTTETLGLVLFEAMAAGLPIVAADSPPTREVLEDGRAGFIFDPDSTESLIATVDLVMRDEARREAVRQRGLAIAEQLDWEGPSKQLLGHYERVLQSFSVVAGAVTGTR

SEQ ID NO: 2 - DNA, 1158 bp, Alicyclobacillus acidocaldarius
gtgagcatgaggatcgcgatgtttacggagacgtttctgccgtcgaccgacgggatcgtcaccaggctctgtgcaacgctgaaatacttggagcgcgagggccacgaggtgctgctgttcgccccgtcgggatcgccggagacctacgcttccgcaaccatcgtcgggatccctgcgatgccgttcatcctgtatccagaaaagcgatactcgttgccgctgccgcgcatcggcaaacatctgcgggcgtttcggccggatctcatccacgtggtgaatccggcgttcctcggcatcgggggcatctactacgcgtggaagtctcatctgccgctggtggcctcgtatcacaccaacgtgccggcctacgctcgccactacaagctggagtttctcgagcccctgttgtggtggtactttcggacgctgcacaaccgggctcacctgaacctcgccacgtctcgcgcgacgctgcgagagctggagcgccaggggtttcagaatctggagctctgggagcgcggcgtggacgtggagctgttccgaaatgctccgtacagcgaggagatgcgccgccgcctggcgcccgaagcgaagccgggcgatcgcgtcctgctgtacgtggggcgcttggcgtcggaaaagaatatcgagcgcatgcgcccggtcctggacgccatcccggatctgcacctcgccatcgtcggcgacggcccgcaccgccctgaactcgagcgcgtgttcgccgggacgcggacccacttcaccggatacctccatggggaggagttggcgcaggcgtatcgcgccgcggacgccttcttgtttccgtcgaccactgagacgctcgggctggtcttgtttgaggcgatggcggccggccttcccatcgtggcggcggacagcccgcccacgcgcgaggtcctcgaggacggccgggcgggattcatcttcgatcccgattcgaccgagtccctcatcgcgaccgtcgatctcgtgatgcgggacgaagcgaggcgagaggcggtcagacagcgcggcttggccatcgcggagcagctggattgggaggggccgagcaagcaactgctcggtcactacgagcgagtcttgcagtcgttcagcgtcgtcgcgggcgccgtcaccggcacccgctga

SEQ ID NO: 3 - protein, 382 aa, Synechococcus sp. WH 7803
MKIAFFTETFLPKVDGIVTRLTKTVKHLVDAGDEVIVFCPEGCPEEYMGARLIGVPAMPLPLYPELKLALPRPAVSEAIDSFQPDLIHVVNPAVLGLGGIWLAKAKSIPLVASYHTHLPKYLEHYGMGMLEPLLWELLKAAHNQALLNLCTSTAMVQELSDKGIQHTDLWQRGVDTELFRPDLRSAELRQRLLGRHDDRGALLLYVGRLSAEKQIERIKPVLEALPDARLALVGDGPHRQQLEKHFEGTATTFVGYLAGEELAGAYASGDAFLFPSSTETLGLVLLEAMAAGCPVVGANRGGIPDIISDGVNGCLYEPDGADGGAASLIAATQRLLGNDVERQALRNAARSEAERWGWAGATEQLRGYYRQVLKQPQLNAAA

SEQ ID NO: 4 - protein, 375 aa, Synechococcus sp. CC9311
MKIAFFTETFLPKVDGIVTRLTKTVKHLVDAGDEVVVFCPEGAPSHYMGAKVVGVPAMPLPLYPELKLALPRPAVSEAIDAFQPDLIHVVNPAVLGLGGIWLAKTKSIPLIASYHTHLPKYLEHYGMGMLEPLLWELLKAAHNQAVLNLCTSTAMVQELSDKGIQHTALWQRGVDTELFRPELRSPELRQRLLGEYDDRGALLLYVGRLSAEKQIERIRPVLEALPDTRLALVGDGPHRQQLEKHFEGTATTFVGYLAGEELAGAYASGDAFLFPSSTETLGLVLLEAMAAGCPVVGANRGGIPDIISDGVNGCLYEPDGADAGAGSLIEATGKLLGNDLERQALRNAARSEAERWGWAGATEQLRGYYRQVLSS

SEQ ID NO: 5 - protein, 368 aa, Synechococcus sp. WH 5701
MKIALFTETFLPKVDGIVTRLTKTVEHLVRAGDEVLLFCPEGAPSLYMGARVIGVPALPLPLYPELKLALPRPAVAEALEAFQPDVVHVVNPAVLGLGGIWMARTRQIPLVASYHTHLPKYLEHYGMGVLEPLLWELLKAAHNQAVLNLCTSSVMVEELAQRGIQHTALWQRGVDTEMFRPELRSDAMRRRLMGRHPDSDSLLLYVGRLSAEKQIERIRPVLDALPQARLALVGDGPHRAQLEKVFEGTATTFVGYLGGEELAGAFASADAFLFPSSTETLGLVLLEAMAAGCPVVGANRGGIPDIVTDGVNGCLYDPDDDASLTAATLRLLASPERREQLRLAARHEAERWGWAGATAQLRRFYRDV

SEQ ID NO: 6 - protein, 374 aa, Synechococcus sp. RS9917
MKIAFFTETFLPKVDGIVTRLTKTVKHLVEAGDEVLVFCPEGAPSEYMGAGVIGVPAMPLPLYPELKLALPRPAVSEAIDAFQPDLVHVVNPAVLGLGGIWLAKNKAIPLIASYHTHLPKYLEHYGMGMLEPLLWELLKAAHNQAELNLCTSTAMVKELSEKGIQHTALWQRGVDTELFRPELRSDAMRQRLLGAHDDRCALLLYVGRLSAEKQIERIRPVLEALPDTRLALVGDGPHRQQLERHFEGTATTFVGYLAGEELASAYASGDAFLFPSSTETLGLVLLEAMAAGCPVVGANRGGIPDIISDGLNGCLYEPDGADGGAASLIQATQRLLGNDLERQALRRAARTEAERWGWAGATEQLRTYYRNVLK

SEQ ID NO: 7 - protein, 374 aa, Synechococcus sp. RS9916
MKVAFFTETFLPKVDGIVTRLTKTVKHLVDAGDEVMVFCPEGCPDNYMGAKLVGVPAMPLPLYPELKLALPRPAVSDAIDAFQPDLIHVVNPAVLGLGGIWLAKTKGIPLVASYHTHLPKYLEHYGMGMLEPLLWEMLKAAHNQALLNLCTSTAMVKELSEKGIQHTDLWQRGVDTDLFRPELRSETMRQRLLGRHDDRGSLLLYVGRLSAEKQIERIKPVLEALPDTRLALVGDGPHRQQLEKHFEGTATTFVGYLAGEELASAYASGDAFLFPSSTETLGLVLLEAMAAGCPVVGANRGGIPDIISDGINGCLYEPDGADEGAASLINAARKLLGNDIERQGLRTAARSEAERWGWAGATEQLRGYYRQVLQ

SEQ ID NO: 8 - protein, 385 aa, Artificial
  Substituion in SEQ ID NO 1
MSMRIAMFTETFLPSTDGIVTRLCATLKYLEREGHEVLLFAPSGSPETYASATIVGIPAMPFILYPEKRYSLPLPRIGKHLRAFRPDLIHVVNPAFLGIGGIYYAWKSHLPLVASYHTNVPAYARHYKLEFLEPLLWWYFRTLHNRAHLNLATSRATLRELERQGFQNLELWERGVDVELFRNAPYSEEMRRRLAPEAKPGDRVLLYVGRLASEKNIERMRPVLDAIPDLHLAIVGDGPHRPELERVFAGTRTHFTGYLHGEELAQAYRAADAFLFPSTTETLGLVLFEAMAAGLPIVAADSPPTREVLEDGRAGFIFDPDSTESLIATVDLVMRDEARREAVRQRGLAIAEQLDWEGPSKQLLGHYERVLNSFSVVAGAVTGTR

SEQ ID NO: 9 - protein, 385 aa, Artificial
  Substituion in SEQ ID NO 1
MSMRIAMFTETFLPSTDGIVTRLCATLKYLEREGHEVLLFAPSGSPETYASATIVGIPAMPFILYPEKRYSLPLPRIGKHLRAFRPDLIHVVNPAFLGIGGIYYAWKSHLPLVASYHTNVPAYARHYKLEFLEPLLWWYFRTLHNRAHLNLATSRATLRELERQGFQNLELWERGVDVELFRNAPYSEEMRRRLAPEAKPGDRVLLYVGRLASEKNIERMRPVLDAIPDLHLAIVGDGPHRPELERVFAGTRTHFTGYLHGEELAQAYRAADAFLFPSTTETLGLVLFEAMAAGLPIVAADSPPTREVLEDGRAGFIFDPDSTESLIATVDLVMRDEARREAVRQRGLAIAEQLDWEGPSKQLLGHYERVLQSFSIVAGAVTGTR

SEQ ID NO: 10 - protein, 385 aa, Artificial
  Substituion in SEQ ID NO 1
MSMRIAMFTETFLPSTDGIVTRLCATLKYLEREGHEVLLFAPSGSPETYASATIVGIPAMPFILYPEKRYSLPIPRIGKHLRAFRPDLIHVVNPAFLGIGGIYYAWKSHLPLVASYHTNVPAYARHYKLEFLEPLLWWYFRTLHNRAHLNLATSRATLRELERQGFQNLELWERGVDVELFRNAPYSEEMRRRLAPEAKPGDRVLLYVGRLASEKNIERMRPVLDAIPDLHLAIVGDGPHRPELERVFAGTRTHFTGYLHGEELAQAYRAADAFLFPSTTETLGLVLFEAMAAGLPIVAADSPPTREVLEDGRAGFIFDPDSTESLIATVDLVMRDEARREAVRQRGLAIAEQLDWEGPSKQLLGHYERVLQSFSVVAGAVTGTR

SEQ ID NO: 11 - protein, 385 aa, Artificial
  Substituion in SEQ ID NO 1
MSMRIAMFTETFLPSTDGIVTRLCATLKYLEREGHEVLLFAPSGSPETYASATIVGIPAMPFILYPEKRYSLPLPRIGKHLRAFRPDLIHVVNPAFLGIGGIYYAWKSHLPLVASYHTNVPAYARHYKLEFLEPLLWWYFRTLHNRAHLNLATSRATLRELERQGFQNLELWERGVDVELFRNAPYSEEMRRRLAPEAKPGDRVLLYVGRLASEKNIERMRPVLDAIPDLHLAIVGDGPHRPELERVFAGTRTHFTGYLHGEELAQAYRAADAFLFPSTTETLGLVLFEAMAAGLPIVAADSPPTREVLEDGRAGFIFDPDSTESLLATVDLVMRDEARREAVRQRGLAIAEQLDWEGPSKQLLGHYERVLQSFSVVAGAVTGTR

SEQ ID NO: 12 - protein, 385 aa, Artificial
  Substituion in SEQ ID NO 1
MSMRIAMFTETFLPSTDGIVTRLCATLKYLEREGHEVLLFAPSGSPETYASATIVGIPAMPFILYPEKRYSLPLPRIGKHLRAFRPDLIHVVNPAFLGIGGIYYAWKSHLPLVASYHTNVPAYARHYKLEFLEPLLWWYFRTLHNRAHLNLATSRATLRELERQGFQNLELWERGVDVELFRNAPYSDEMRRRLAPEAKPGDRVLLYVGRLASEKNIERMRPVLDAIPDLHLAIVGDGPHRPELERVFAGTRTHFTGYLHGEELAQAYRAADAFLFPSTTETLGLVLFEAMAAGLPIVAADSPPTREVLEDGRAGFIFDPDSTESLIATVDLVMRDEARREAVRQRGLAIAEQLDWEGPSKQLLGHYERVLQSFSVVAGAVTGTR

SEQ ID NO: 13 - DNA, 1158 bp, Artificial
  Substituion in SEQ ID NO 2
gtgagcatgaggatcgcgatgtttacggagacgtttctgccgtcgaccgacgggatcgtcaccaggctctgtgcaacgctgaaatacttggagcgcgagggccacgaggtgctgctgttcgccccgtcgggatcgccggagacctacgcttccgcaaccatcgtcgggatccctgcgatgccgttcatcctgtatccagaaaagcgatactcgttgccgctgccgcgcatcggcaaacatctgcgggcgtttcggccggatctcatccacgtggtgaatccggcgttcctcggcatcgggggcatctactacgcgtggaagtctcatctgccgctggtggcctcgtatcacaccaacgtgccggcctacgctcgccactacaagctggagtttctcgagcccctgttgtggtggtactttcggacgctgcacaaccgggctcacctgaacctcgccacgtctcgcgcgacgctgcgagagctggagcgccaggggtttcagaatctggagctctgggagcgcggcgtggacgtggagctgttccgaaatgctccgtacagcgaggagatgcgccgccgcctggcgcccgaagcgaagccgggcgatcgcgtcctgctgtacgtggggcgcttggcgtcggaaaagaatatcgagcgcatgcgcccggtcctggacgccatcccggatctgcacctcgccatcgtcggcgacggcccgcaccgccctgaactcgagcgcgtgttcgccgggacgcggacccacttcaccggatacctccatggggaggagttggcgcaggcgtatcgcgccgcggacgccttcttgtttccgtcgaccactgagacgctcgggctggtcttgtttgaggcgatggcggccggccttcccatcgtggcggcggacagcccgcccacgcgcgaggtcctcgaggacggccgggcgggattcatcttcgatcccgattcgaccgagtccctcatcgcgaccgtcgatctcgtgatgcgggacgaagcgaggcgagaggcggtcagacagcgcggcttggccatcgcggagcagctggattgggaggggccgagcaagcaactgctcggtcactacgagcgagtcttgaattcgttcagcgtcgtcgcgggcgccgtcaccggcacccgctga

SEQ ID NO: 14 - DNA, 1158 bp, Artificial
  Substituion in SEQ ID NO 2
gtgagcatgaggatcgcgatgtttacggagacgtttctgccgtcgaccgacgggatcgtcaccaggctctgtgcaacgctgaaatacttggagcgcgagggccacgaggtgctgctgttcgccccgtcgggatcgccggagacctacgcttccgcaaccatcgtcgggatccctgcgatgccgttcatcctgtatccagaaaagcgatactcgttgccgctgccgcgcatcggcaaacatctgcgggcgtttcggccggatctcatccacgtggtgaatccggcgttcctcggcatcgggggcatctactacgcgtggaagtctcatctgccgctggtggcctcgtatcacaccaacgtgccggcctacgctcgccactacaagctggagtttctcgagcccctgttgtggtggtactttcggacgctgcacaaccgggctcacctgaacctcgccacgtctcgcgcgacgctgcgagagctggagcgccaggggtttcagaatctggagctctgggagcgcggcgtggacgtggagctgttccgaaatgctccgtacagcgaggagatgcgccgccgcctggcgcccgaagcgaagccgggcgatcgcgtcctgctgtacgtggggcgcttggcgtcggaaaagaatatcgagcgcatgcgcccggtcctggacgccatcccggatctgcacctcgccatcgtcggcgacggcccgcaccgccctgaactcgagcgcgtgttcgccgggacgcggacccacttcaccggatacctccatggggaggagttggcgcaggcgtatcgcgccgcggacgccttcttgtttccgtcgaccactgagacgctcgggctggtcttgtttgaggcgatggcggccggccttcccatcgtggcggcggacagcccgcccacgcgcgaggtcctcgaggacggccgggcgggattcatcttcgatcccgattcgaccgagtccctcatcgcgaccgtcgatctcgtgatgcgggacgaagcgaggcgagaggcggtcagacagcgcggcttggccatcgcggagcagctggattgggaggggccgagcaagcaactgctcggtcactacgagcgagtcttgcagtcgttcagcattgtcgcgggcgccgtcaccggcacccgctga

SEQ ID NO: 15 - DNA, 1158 bp, Artificial
  Substituion in SEQ ID NO 2
gtgagcatgaggatcgcgatgtttacggagacgtttctgccgtcgaccgacgggatcgtcaccaggctctgtgcaacgctgaaatacttggagcgcgagggccacgaggtgctgctgttcgccccgtcgggatcgccggagacctacgcttccgcaaccatcgtcgggatccctgcgatgccgttcatcctgtatccagaaaagcgatactcgttgccgattccgcgcatcggcaaacatctgcgggcgtttcggccggatctcatccacgtggtgaatccggcgttcctcggcatcgggggcatctactacgcgtggaagtctcatctgccgctggtggcctcgtatcacaccaacgtgccggcctacgctcgccactacaagctggagtttctcgagcccctgttgtggtggtactttcggacgctgcacaaccgggctcacctgaacctcgccacgtctcgcgcgacgctgcgagagctggagcgccaggggtttcagaatctggagctctgggagcgcggcgtggacgtggagctgttccgaaatgctccgtacagcgaggagatgcgccgccgcctggcgcccgaagcgaagccgggcgatcgcgtcctgctgtacgtggggcgcttggcgtcggaaaagaatatcgagcgcatgcgcccggtcctggacgccatcccggatctgcacctcgccatcgtcggcgacggcccgcaccgccctgaactcgagcgcgtgttcgccgggacgcggacccacttcaccggatacctccatggggaggagttggcgcaggcgtatcgcgccgcggacgccttcttgtttccgtcgaccactgagacgctcgggctggtcttgtttgaggcgatggcggccggccttcccatcgtggcggcggacagcccgcccacgcgcgaggtcctcgaggacggccgggcgggattcatcttcgatcccgattcgaccgagtccctcatcgcgaccgtcgatctcgtgatgcgggacgaagcgaggcgagaggcggtcagacagcgcggcttggccatcgcggagcagctggattgggaggggccgagcaagcaactgctcggtcactacgagcgagtcttgcagtcgttcagcgtcgtcgcgggcgccgtcaccggcacccgctga

SEQ ID NO: 16 - DNA, 1158 bp, Artificial
  Substituion in SEQ ID NO 2
gtgagcatgaggatcgcgatgtttacggagacgtttctgccgtcgaccgacgggatcgtcaccaggctctgtgcaacgctgaaatacttggagcgcgagggccacgaggtgctgctgttcgccccgtcgggatcgccggagacctacgcttccgcaaccatcgtcgggatccctgcgatgccgttcatcctgtatccagaaaagcgatactcgttgccgctgccgcgcatcggcaaacatctgcgggcgtttcggccggatctcatccacgtggtgaatccggcgttcctcggcatcgggggcatctactacgcgtggaagtctcatctgccgctggtggcctcgtatcacaccaacgtgccggcctacgctcgccactacaagctggagtttctcgagcccctgttgtggtggtactttcggacgctgcacaaccgggctcacctgaacctcgccacgtctcgcgcgacgctgcgagagctggagcgccaggggtttcagaatctggagctctgggagcgcggcgtggacgtggagctgttccgaaatgctccgtacagcgaggagatgcgccgccgcctggcgcccgaagcgaagccgggcgatcgcgtcctgctgtacgtggggcgcttggcgtcggaaaagaatatcgagcgcatgcgcccggtcctggacgccatcccggatctgcacctcgccatcgtcggcgacggcccgcaccgccctgaactcgagcgcgtgttcgccgggacgcggacccacttcaccggatacctccatggggaggagttggcgcaggcgtatcgcgccgcggacgccttcttgtttccgtcgaccactgagacgctcgggctggtcttgtttgaggcgatggcggccggccttcccatcgtggcggcggacagcccgcccacgcgcgaggtcctcgaggacggccgggcgggattcatcttcgatcccgattcgaccgagtccctcttagcgaccgtcgatctcgtgatgcgggacgaagcgaggcgagaggcggtcagacagcgcggcttggccatcgcggagcagctggattgggaggggccgagcaagcaactgctcggtcactacgagcgagtcttgcagtcgttcagcgtcgtcgcgggcgccgtcaccggcacccgctga

SEQ ID NO: 17 - DNA, 1158 bp, Artificial
  Substituion in SEQ ID NO 2
gtgagcatgaggatcgcgatgtttacggagacgtttctgccgtcgaccgacgggatcgtcaccaggctctgtgcaacgctgaaatacttggagcgcgagggccacgaggtgctgctgttcgccccgtcgggatcgccggagacctacgcttccgcaaccatcgtcgggatccctgcgatgccgttcatcctgtatccagaaaagcgatactcgttgccgctgccgcgcatcggcaaacatctgcgggcgtttcggccggatctcatccacgtggtgaatccggcgttcctcggcatcgggggcatctactacgcgtggaagtctcatctgccgctggtggcctcgtatcacaccaacgtgccggcctacgctcgccactacaagctggagtttctcgagcccctgttgtggtggtactttcggacgctgcacaaccgggctcacctgaacctcgccacgtctcgcgcgacgctgcgagagctggagcgccaggggtttcagaatctggagctctgggagcgcggcgtggacgtggagctgttccgaaatgctccgtacagcgatgagatgcgccgccgcctggcgcccgaagcgaagccgggcgatcgcgtcctgctgtacgtggggcgcttggcgtcggaaaagaatatcgagcgcatgcgcccggtcctggacgccatcccggatctgcacctcgccatcgtcggcgacggcccgcaccgccctgaactcgagcgcgtgttcgccgggacgcggacccacttcaccggatacctccatggggaggagttggcgcaggcgtatcgcgccgcggacgccttcttgtttccgtcgaccactgagacgctcgggctggtcttgtttgaggcgatggcggccggccttcccatcgtggcggcggacagcccgcccacgcgcgaggtcctcgaggacggccgggcgggattcatcttcgatcccgattcgaccgagtccctcatcgcgaccgtcgatctcgtgatgcgggacgaagcgaggcgagaggcggtcagacagcgcggcttggccatcgcggagcagctggattgggaggggccgagcaagcaactgctcggtcactacgagcgagtcttgcagtcgttcagcgtcgtcgcgggcgccgtcaccggcacccgctga

SEQ ID NO: 18 - protein, 393 aa, Alicyclobacillus acidocaldarius
MCGGDTEFETFGGRRCEHMHGPVLFYDGLICLIALLNRLLWPRLNRDRENVGPKAETFTSGRWKNLAPVALLIPARNEAHQIRRCLEAIGTSTDSSLEIIALDDESTDDTWSVLKETKAEANQNLTLLRGTPRPQGWRGKNWACAQLADHAGDAEILIFIDADTRLEAGAVENIRSTMLARDIQLLSVLPRQEAHGLAALLVYLLPWSLMAHVPLFLGRWRRKALPIAIGQVLAFQRSAYQTLGGHAAVRSAIAEDLALARKAARMGMIGAFLDGADIASCTMYTSWVRAWRGFQKNWCYTVGHPLLSCLIWAWLTYAFTWLPMYGLAEACLGHLDLAALSQWPALLWIGVCSKRYLQMPIWVFVTAPISVALGFVLACDSWIHNARNTTIWS

SEQ ID NO: 19 - DNA, 1182 bp, Alicyclobacillus acidocaldarius
ttgtgtggtggggataccgagttcgaaacgttcggcggaaggaggtgtgaacacatgcatggaccggtgctattctacgatggcctgatttgcctcattgcgctgttgaaccgcctcctgtggccccgtttgaaccgggacagggaaaacgtcgggcccaaggcggaaaccttcacgagtggacggtggaagaatcttgcgcccgtcgccctcctgattccggcgcggaacgaagcgcaccagattcggcggtgcctcgaggccattggtacgagtaccgattcatcccttgaaattatcgcgctggacgatgagtccacggacgacacgtggagcgtgttgaaagagacgaaggccgaagcgaatcagaacctgacccttcttcgcggaaccccaaggccacagggatggcgagggaaaaactgggcatgcgctcaactggccgatcacgccggagacgccgaaatcctcattttcatcgacgcggacacgcgtctcgaagcaggcgccgtcgagaacatccgatccaccatgcttgcgcgagacatccaacttctttccgtcctgccacgccaagaagcacacggcctggccgccttgcttgtctatttgctcccttggagcttgatggcccacgttcccttgtttctgggccgatggcgtcggaaagccctcccgattgccatcggccaggtgctcgccttccagcgctcggcctatcagacccttggcggccacgcggctgtacgcagcgccatcgctgaggatctcgcgctcgcgcggaaagcagccaggatgggaatgataggcgcctttctagatggggccgatatcgcctcctgcaccatgtacacgtcctgggtccgggcgtggcgcggcttccagaaaaactggtgttacaccgtcggccaccccctgctttcgtgtctcatctgggcgtggctcacgtatgcgttcacatggctacccatgtacggccttgcggaagcctgcctgggacatctcgatctcgccgccctctcgcaatggcccgcgctgctctggataggagtctgctccaaaagatacctgcagatgccgatatgggtgtttgtcacggcgcccatcagtgttgccctcggctttgtgctcgcatgcgattcgtggatacacaatgcgcgcaacacgaccatttggtcgtag

SEQ ID NO: 20 - protein, 294 aa, Pelodictyon phaeoclathratiforme BU-1
VSVLVPARNEALNIERCVRSLMRQEYAPFEILVLDDDSTDATPELLRRLVVESGGKVRIVQGEALPDGWHGKSWACSQLGHQAKGELLLFTDADTTHKPDALRRTVGAMQASGADMLSLMPHQELGSFWEKLVVPLVHVILMCYLPLRFVRTSRRAAFCFANGQFILFRRECYTRINGHAAVREAIVEDVWLCKSVKKAGGTVVAFNGSDIVSCRMYHNFREIWEGFSKNLFAALGYSTPGLFVLILMISALYLVPCLFFSYALIAGEFTVSLFWLPLMQMMVALLCRIFIARI

SEQ ID NO: 21 - protein, 317 aa, Chlorobium ferrooxidans DSM 13031
VSVLVPARNEALNIERCVRSLLMQDYAAFEILVLDDGSTDATPQLLQTLLDESGGRLRVLQGEPLPDGWHGKAWACLQLSRQAKGDLLLFTDADTKHEPDALRRSVAALNSEKGDMLSLTPRQELGSLWEELVVPLVYVILLCYLPLRLVRTSRNPAFCFANGQFILFRREFYDRINGHTAVRQALAEDIGLCREVKRAGGRVVAFNGFDAVSCRMYRSFRDIWEGFSKNLYASLGYSTPGLFLLMTLTAAFYIAPYLFFFYALIAGKFTMLLFWLPLTQMVIALLSRVIIARLFGQSTAMVFLNLFSQLILIAIAW

SEQ ID NO: 22 - protein, 320 aa, Chlorobium chlorochromatii CaD3
VSILVPARNEAHNIERCINSLLQQRYESFEVLVLDDGSTDATPTLLAELAQHAGGVLQVLQGDPLPQGWHGKAWACQQLGEAAHGDLLLFTDADTVHHPTALARSVAALQASQASMLSMTPLQTMHSWWEKIVVPLVYVVLMNFLPLRFVRTTSIPAFSFANGQFILIERTMYRQLNGHAAVRQQLVEDVWLCMAVKKAGGRVVAINGVDLVSCRMYRSGKEVWEGFSKNIFAGLGYYHSALFGLLALIALFYIIPIALLTTSVVQANYSATHFWLPLVQVVLAFANRWLVAFTFHQSRFMVFFHPLTMVAFFAIACNSW

SEQ ID NO: 23 - protein, 271 aa, Chlorobium limicola DSM 245
VSVLVPVRNEEHVIEACVLSLLAQDYPRYEVVVLDDCSEDRSLEILRRLEAASGSRLRIVQGKPLPEGWHGKAWACRQLGDLGGGELLLFTDADTRHKPEGISRSVAALYESGADMLTLTPYQEMAGFLEKLVIPLVYFILMCYLPLRFVRTSPKSVFCSAIGQFMLFRREIYRNIGGHRAVKAAIVEDVWLCREVKKAGGRVAVYNGIDALSCRMYRSPGEIIRGFSKNLFAGLGYRSFGLFSLVVLTLAFHVLPYGFLTAALLSGDFSA

SEQ ID NO: 24 - protein, 319 aa, Pelodictyon luteolum DSM 273
VSVLVPARNEERSIARCVQSLLMQDYPDFEVIVLDDASTDATLSILQALEAESCGRLRVLRGAVLPEGWHGKSWACRQLAEKASGEMLLFTDADTFHRPQALRRAVTALQEGRGDMLSITPRQELGSFFEHLVVPLVYVILMSYLPLRLVRTLRNPAFCFANGQFILFRREFYWKVNGHEAVRDALVEDVWLCMAVKKAGGRVLSFNGTDALSCRMYRNFREVWEGFSKNVFAGLGSSIPGLAAFVLFTAAFHLAPWGFLLYALFVGASGPALVLLPLLQLAVALSGRVLVARRFDQPTALTLLDPLARGLLLAIALNS

SEQ ID NO: 25 - protein, 393 aa, Artificial
  Substituion in SEQ ID NO 18
MCGGDTEFETFGGRRCEHMHGPVLFYDGLICLIALLNRLLWPRLNRDRENVGPRAETFTSGRWKNLAPVALLIPARNEAHQIRRCLEAIGTSTDSSLEIIALDDESTDDTWSVLKETKAEANQNLTLLRGTPRPQGWRGKNWACAQLADHAGDAEILIFIDADTRLEAGAVENIRSTMLARDIQLLSVLPRQEAHGLAALLVYLLPWSLMAHVPLFLGRWRRKALPIAIGQVLAFQRSAYQTLGGHAAVRSAIAEDLALARKAARMGMIGAFLDGADIASCTMYTSWVRAWRGFQKNWCYTVGHPLLSCLIWAWLTYAFTWLPMYGLAEACLGHLDLAALSQWPALLWIGVCSKRYLQMPIWVFVTAPISVALGFVLACDSWIHNARNTTIWS

SEQ ID NO: 26 - protein, 393 aa, Artificial
  Substituion in SEQ ID NO 18
MCGGDTEFETFGGRRCEHMHGPVLFYDGLICLIALLNRLLWPRLNRDRENVGPKAETFTSGRWKNLAPVALLIPARNEAHNIRRCLEAIGTSTDSSLEIIALDDESTDDTWSVLKETKAEANQNLTLLRGTPRPQGWRGKNWACAQLADHAGDAEILIFIDADTRLEAGAVENIRSTMLARDIQLLSVLPRQEAHGLAALLVYLLPWSLMAHVPLFLGRWRRKALPIAIGQVLAFQRSAYQTLGGHAAVRSAIAEDLALARKAARMGMIGAFLDGADIASCTMYTSWVRAWRGFQKNWCYTVGHPLLSCLIWAWLTYAFTWLPMYGLAEACLGHLDLAALSQWPALLWIGVCSKRYLQMPIWVFVTAPISVALGFVLACDSWIHNARNTTIWS

SEQ ID NO: 27 - protein, 393 aa, Artificial
  Substituion in SEQ ID NO 18
MCGGDTEFETFGGRRCEHMHGPVLFYDGLICLIALLNRLLWPRINRDRENVGPKAETFTSGRWKNLAPVALLIPARNEAHQIRRCLEAIGTSTDSSLEIIALDDESTDDTWSVLKETKAEANQNLTLLRGTPRPQGWRGKNWACAQLADHAGDAEILIFIDADTRLEAGAVENIRSTMLARDIQLLSVLPRQEAHGLAALLVYLLPWSLMAHVPLFLGRWRRKALPIAIGQVLAFQRSAYQTLGGHAAVRSAIAEDLALARKAARMGMIGAFLDGADIASCTMYTSWVRAWRGFQKNWCYTVGHPLLSCLIWAWLTYAFTWLPMYGLAEACLGHLDLAALSQWPALLWIGVCSKRYLQMPIWVFVTAPISVALGFVLACDSWIHNARNTTIWS

SEQ ID NO: 28 - protein, 393 aa, Artificial
  Substituion in SEQ ID NO 18
MCGGDTEFETFGGRRCEHMHGPVLFYDGLICLIALLNRLLWPRLNRDRENVGPKAETFTSGRWKNLAPVALLIPARNEAHQIRRCLEAIGTSTDSSLEIIALDDESTDDTWSVLKETKAEANQNLTLLRGTPRPQGWRGKNWACAQLADHAGDAEILIFIDADTRLEAGAVDNIRSTMLARDIQLLSVLPRQEAHGLAALLVYLLPWSLMAHVPLFLGRWRRKALPIAIGQVLAFQRSAYQTLGGHAAVRSAIAEDLALARKAARMGMIGAFLDGADIASCTMYTSWVRAWRGFQKNWCYTVGHPLLSCLIWAWLTYAFTWLPMYGLAEACLGHLDLAALSQWPALLWIGVCSKRYLQMPIWVFVTAPISVALGFVLACDSWIHNARNTTIWS

SEQ ID NO: 29 - protein, 393 aa, Artificial
  Substituion in SEQ ID NO 18
MCGGDTEFETFGGRRCEHMHGPVLFYDGLICLIALLNRLLWPRLNRDRENVGPKAETFTSGRWKNLAPVALLIPARNEAHQIRRCLEAIGTSTDSSLEIIALDDESTDDTWSVLKETKAEANQNLTLLRGTPRPQGWRGKNWACAQLADHAGDAEILIFIDADTRLEAGAVENIRSTMLARDIQLLSVLPRQDAHGLAALLVYLLPWSLMAHVPLFLGRWRRKALPIAIGQVLAFQRSAYQTLGGHAAVRSAIAEDLALARKAARMGMIGAFLDGADIASCTMYTSWVRAWRGFQKNWCYTVGHPLLSCLIWAWLTYAFTWLPMYGLAEACLGHLDLAALSQWPALLWIGVCSKRYLQMPIWVFVTAPISVALGFVLACDSWIHNARNTTIWS

SEQ ID NO: 30 - DNA, 1182 bp, Artificial
  Substituion in SEQ ID NO 19
ttgtgtggtggggataccgagttcgaaacgttcggcggaaggaggtgtgaacacatgcatggaccggtgctattctacgatggcctgatttgcctcattgcgctgttgaaccgcctcctgtggccccgtttgaaccgggacagggaaaacgtcgggccccgtgcggaaaccttcacgagtggacggtggaagaatcttgcgcccgtcgccctcctgattccggcgcggaacgaagcgcaccagattcggcggtgcctcgaggccattggtacgagtaccgattcatcccttgaaattatcgcgctggacgatgagtccacggacgacacgtggagcgtgttgaaagagacgaaggccgaagcgaatcagaacctgacccttcttcgcggaaccccaaggccacagggatggcgagggaaaaactgggcatgcgctcaactggccgatcacgccggagacgccgaaatcctcattttcatcgacgcggacacgcgtctcgaagcaggcgccgtcgagaacatccgatccaccatgcttgcgcgagacatccaacttctttccgtcctgccacgccaagaagcacacggcctggccgccttgcttgtctatttgctcccttggagcttgatggcccacgttcccttgtttctgggccgatggcgtcggaaagccctcccgattgccatcggccaggtgctcgccttccagcgctcggcctatcagacccttggcggccacgcggctgtacgcagcgccatcgctgaggatctcgcgctcgcgcggaaagcagccaggatgggaatgataggcgcctttctagatggggccgatatcgcctcctgcaccatgtacacgtcctgggtccgggcgtggcgcggcttccagaaaaactggtgttacaccgtcggccaccccctgctttcgtgtctcatctgggcgtggctcacgtatgcgttcacatggctacccatgtacggccttgcggaagcctgcctgggacatctcgatctcgccgccctctcgcaatggcccgcgctgctctggataggagtctgctccaaaagatacctgcagatgccgatatgggtgtttgtcacggcgcccatcagtgttgccctcggctttgtgctcgcatgcgattcgtggatacacaatgcgcgcaacacgaccatttggtcgtag

SEQ ID NO: 31 - DNA, 1182 bp, Artificial
  Substituion in SEQ ID NO 19
ttgtgtggtggggataccgagttcgaaacgttcggcggaaggaggtgtgaacacatgcatggaccggtgctattctacgatggcctgatttgcctcattgcgctgttgaaccgcctcctgtggccccgtttgaaccgggacagggaaaacgtcgggcccaaggcggaaaccttcacgagtggacggtggaagaatcttgcgcccgtcgccctcctgattccggcgcggaacgaagcgcacaatattcggcggtgcctcgaggccattggtacgagtaccgattcatcccttgaaattatcgcgctggacgatgagtccacggacgacacgtggagcgtgttgaaagagacgaaggccgaagcgaatcagaacctgacccttcttcgcggaaccccaaggccacagggatggcgagggaaaaactgggcatgcgctcaactggccgatcacgccggagacgccgaaatcctcattttcatcgacgcggacacgcgtctcgaagcaggcgccgtcgagaacatccgatccaccatgcttgcgcgagacatccaacttctttccgtcctgccacgccaagaagcacacggcctggccgccttgcttgtctatttgctcccttggagcttgatggcccacgttcccttgtttctgggccgatggcgtcggaaagccctcccgattgccatcggccaggtgctcgccttccagcgctcggcctatcagacccttggcggccacgcggctgtacgcagcgccatcgctgaggatctcgcgctcgcgcggaaagcagccaggatgggaatgataggcgcctttctagatggggccgatatcgcctcctgcaccatgtacacgtcctgggtccgggcgtggcgcggcttccagaaaaactggtgttacaccgtcggccaccccctgctttcgtgtctcatctgggcgtggctcacgtatgcgttcacatggctacccatgtacggccttgcggaagcctgcctgggacatctcgatctcgccgccctctcgcaatggcccgcgctgctctggataggagtctgctccaaaagatacctgcagatgccgatatgggtgtttgtcacggcgcccatcagtgttgccctcggctttgtgctcgcatgcgattcgtggatacacaatgcgcgcaacacgaccatttggtcgtag

SEQ ID NO: 32 - DNA, 1182 bp, Artificial
  Substituion in SEQ ID NO 19
ttgtgtggtggggataccgagttcgaaacgttcggcggaaggaggtgtgaacacatgcatggaccggtgctattctacgatggcctgatttgcctcattgcgctgttgaaccgcctcctgtggccccgtattaaccgggacagggaaaacgtcgggcccaaggcggaaaccttcacgagtggacggtggaagaatcttgcgcccgtcgccctcctgattccggcgcggaacgaagcgcaccagattcggcggtgcctcgaggccattggtacgagtaccgattcatcccttgaaattatcgcgctggacgatgagtccacggacgacacgtggagcgtgttgaaagagacgaaggccgaagcgaatcagaacctgacccttcttcgcggaaccccaaggccacagggatggcgagggaaaaactgggcatgcgctcaactggccgatcacgccggagacgccgaaatcctcattttcatcgacgcggacacgcgtctcgaagcaggcgccgtcgagaacatccgatccaccatgcttgcgcgagacatccaacttctttccgtcctgccacgccaagaagcacacggcctggccgccttgcttgtctatttgctcccttggagcttgatggcccacgttcccttgtttctgggccgatggcgtcggaaagccctcccgattgccatcggccaggtgctcgccttccagcgctcggcctatcagacccttggcggccacgcggctgtacgcagcgccatcgctgaggatctcgcgctcgcgcggaaagcagccaggatgggaatgataggcgcctttctagatggggccgatatcgcctcctgcaccatgtacacgtcctgggtccgggcgtggcgcggcttccagaaaaactggtgttacaccgtcggccaccccctgctttcgtgtctcatctgggcgtggctcacgtatgcgttcacatggctacccatgtacggccttgcggaagcctgcctgggacatctcgatctcgccgccctctcgcaatggcccgcgctgctctggataggagtctgctccaaaagatacctgcagatgccgatatgggtgtttgtcacggcgcccatcagtgttgccctcggctttgtgctcgcatgcgattcgtggatacacaatgcgcgcaacacgaccatttggtcgtag

SEQ ID NO: 33 - DNA, 1182 bp, Artificial
  Substituion in SEQ ID NO 19
ttgtgtggtggggataccgagttcgaaacgttcggcggaaggaggtgtgaacacatgcatggaccggtgctattctacgatggcctgatttgcctcattgcgctgttgaaccgcctcctgtggccccgtttgaaccgggacagggaaaacgtcgggcccaaggcggaaaccttcacgagtggacggtggaagaatcttgcgcccgtcgccctcctgattccggcgcggaacgaagcgcaccagattcggcggtgcctcgaggccattggtacgagtaccgattcatcccttgaaattatcgcgctggacgatgagtccacggacgacacgtggagcgtgttgaaagagacgaaggccgaagcgaatcagaacctgacccttcttcgcggaaccccaaggccacagggatggcgagggaaaaactgggcatgcgctcaactggccgatcacgccggagacgccgaaatcctcattttcatcgacgcggacacgcgtctcgaagcaggcgccgtcgataacatccgatccaccatgcttgcgcgagacatccaacttctttccgtcctgccacgccaagaagcacacggcctggccgccttgcttgtctatttgctcccttggagcttgatggcccacgttcccttgtttctgggccgatggcgtcggaaagccctcccgattgccatcggccaggtgctcgccttccagcgctcggcctatcagacccttggcggccacgcggctgtacgcagcgccatcgctgaggatctcgcgctcgcgcggaaagcagccaggatgggaatgataggcgcctttctagatggggccgatatcgcctcctgcaccatgtacacgtcctgggtccgggcgtggcgcggcttccagaaaaactggtgttacaccgtcggccaccccctgctttcgtgtctcatctgggcgtggctcacgtatgcgttcacatggctacccatgtacggccttgcggaagcctgcctgggacatctcgatctcgccgccctctcgcaatggcccgcgctgctctggataggagtctgctccaaaagatacctgcagatgccgatatgggtgtttgtcacggcgcccatcagtgttgccctcggctttgtgctcgcatgcgattcgtggatacacaatgcgcgcaacacgaccatttggtcgtag

SEQ ID NO: 34 - DNA, 1182 bp, Artificial
  Substituion in SEQ ID NO 19
ttgtgtggtggggataccgagttcgaaacgttcggcggaaggaggtgtgaacacatgcatggaccggtgctattctacgatggcctgatttgcctcattgcgctgttgaaccgcctcctgtggccccgtttgaaccgggacagggaaaacgtcgggcccaaggcggaaaccttcacgagtggacggtggaagaatcttgcgcccgtcgccctcctgattccggcgcggaacgaagcgcaccagattcggcggtgcctcgaggccattggtacgagtaccgattcatcccttgaaattatcgcgctggacgatgagtccacggacgacacgtggagcgtgttgaaagagacgaaggccgaagcgaatcagaacctgacccttcttcgcggaaccccaaggccacagggatggcgagggaaaaactgggcatgcgctcaactggccgatcacgccggagacgccgaaatcctcattttcatcgacgcggacacgcgtctcgaagcaggcgccgtcgagaacatccgatccaccatgcttgcgcgagacatccaacttctttccgtcctgccacgccaagatgcacacggcctggccgccttgcttgtctatttgctcccttggagcttgatggcccacgttcccttgtttctgggccgatggcgtcggaaagccctcccgattgccatcggccaggtgctcgccttccagcgctcggcctatcagacccttggcggccacgcggctgtacgcagcgccatcgctgaggatctcgcgctcgcgcggaaagcagccaggatgggaatgataggcgcctttctagatggggccgatatcgcctcctgcaccatgtacacgtcctgggtccgggcgtggcgcggcttccagaaaaactggtgttacaccgtcggccaccccctgctttcgtgtctcatctgggcgtggctcacgtatgcgttcacatggctacccatgtacggccttgcggaagcctgcctgggacatctcgatctcgccgccctctcgcaatggcccgcgctgctctggataggagtctgctccaaaagatacctgcagatgccgatatgggtgtttgtcacggcgcccatcagtgttgccctcggctttgtgctcgcatgcgattcgtggatacacaatgcgcgcaacacgaccatttggtcgtag

SEQ ID NO: 35 - protein, 384 aa, Alicyclobacillus acidocaldarius
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLIGIAARLDPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVRSGWRLPANSEQTR

SEQ ID NO: 36 - DNA, 1155 bp, Alicyclobacillus acidocaldarius
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 37 - protein, 359 aa, Geobacillus thermodenitrificans NG80-2
VLHVISGGETGGSRKHVVTLLSKFAPGTATLVVFQDGPLAAEARQAGIDVRLLAQSSRYDLSVLSKLVALIRRERFDILHTHGPRANLYGALIKRKIAIPWMTTVHSDPRLDFMKSGWKGKWFTRLNVWALQKVDYFFAVSERFKESLMELGIAAERIQTIYNGIDFDDAPRPHMLQRADLGLREDDLVIAMVARLHPIKGHALVFEALASLSDPDMKLLVVGDGPLASELREKATQSGIGRQVQFLGFRRDVADIYALSDVALMASYSESFPLALLEAANERLPVISTDVGGVSQLIASSDMGWIVPVGDRAALAQAMREARSRRHELKTMGKRLYEHASTHFSLQRLYEETMATYER

SEQ ID NO: 38 - protein, 367 aa, Bacteroides capillosus ATCC 29799
VIHLISGGDSGGAKTHVHMLLQNLSRTPGVEVTMVCFMEGPFSQEARELGISTVVLPGKNIFRTFHTLKNMIREGGYEIIHCHGARGNMMGALLRKATGLPVVTTVHSDYRLDYMGRPISRITYGTINTLALRLLDYRIGVSDAMTDLLISRGFDPDKLFTIYNGIDFTPRTPSMTRSEYLKSVGANWPEDCVVAGIAARLNPVKDIPTLIRGFAQARQSCPKLRLLIAGDGEQMNELKALAADLGVAEDVCFAGWVSDVDSFYGALDINTLTSLSETFPYSLTEGARAGLPTVASRVGGVPYLIDHGVNGLLFEAGDYETLAKHLTALASDETMRTHMGQRLYQKGKNDYSLESTLQRQLEIYSVI

SEQ ID NO: 39 - protein, 314 aa, Bacillus weihenstephanensis KBAB4
AGAEDGGGKTHIISLLDQFPDGEVELAVFEDGIVAKEARELGIKVHVFSQKSRYDLSILKNISEFINKEKFDVVHTHGPRANFFVSLMKKKFAAKWVTTIHSDPFQDFTKQGLKGWIFTKLNLKALKNIDLFFVVTNRLKKSLAALGISNEKMHVIYNGIEYDQEKADGYNKKEMFNIDEDVFTAIQVARLHPVKGHEVLFDALQQTKLEKIKVLLVGDGPLERELKALATEKGINDKVEFLGHRQDVKQLFASSHVNLLTSHSEGFPLVLLEAANQRVPSIVTRAGEIEPLIADETYGWIVPTGDGKALASAL

SEQ ID NO: 40 - protein, 316 aa, Bacillus cereus subsp. cytotoxis NVH 391-98
AGAEDGGGKTHIISLLDQFPTDEVELAVFEDGIVAREAREIGIKVHVFSQKSRYDLSILKNISRFINEEQFDIVHTHGPRANFYVSLMKKRIAAKWVTTIHSDPFQDFTKQGLKGWIFTKLNLKALKDIDLFFVVTNRLKKSLEQLGISSEKMRVIYNGIEYDKEKAQGYDKKEKFHIEEDVFTAIQVARLHPVKGHEVLFDALNNTSLTKIKVLLVGDGPLEEDLKALAKEKGIDDKVQFLGHRQDVKQLFASAHINLLTSHSEGFPLVLLEAANQRVPSIVTRAGEIEPLIVDDTYGWVVPVGDGKALANALEQ

SEQ ID NO: 41 - protein, 314 aa, Bacillus cereus ATCC 14579
AGAEDGGGKTHIISLLDQFPTGEVELAVFEDGIVAKEARELGIKVHVFSQKSRYDLSILKNISEFINKEKFDVVHTHGPRANFYVSLMKKRIKAKWVTTIHSDPFQDFTKQGLKGWIFTKLNLKALKNIDLFFVVTNRLKKSLAALGISNEKMHVIYNGIEYDKEKAEGYNKKEMFNIDEDVFTAIQVARLHPVKGHEVLFDALQQTKLEKIKVLLVGDGPLEENLKSLATEKGINDKVEFLGHRQDVKQLFASSHVNLLTSHSEGFPLVLLEAANQRVPSIVTRAGEIEPLIVDETYGWIVPTGDGKALALAL

SEQ ID NO: 42 - protein, 384 aa, Artificial
  Substituion in SEQ ID NO 35
MASERTVIVFFAGNEVGGAATHLATWAKALKGAQVDYRYRFVSLGDGPLADELRQMGMLHGAVAGTVGAIKDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLIGIAARLDPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVRSGWRLPANSEQTR

SEQ ID NO: 43 - protein, 384 aa, Artificial
  Substituion in SEQ ID NO 35
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLIGIAARLDPVKQIDVAIAALALLSDLDVHLLVAGDGRDRIRLEAAADDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVRSGWRLPANSEQTR

SEQ ID NO: 44 - protein, 384 aa, Artificial
  Substituion in SEQ ID NO 35
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLIGIAARLDPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEEAVRSGWRLPANSEQTR

SEQ ID NO: 45 - protein, 384 aa, Artificial
  Substituion in SEQ ID NO 35
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTILEVPNAFFPRLPRASRDVCAAEWRRRLGLNPESRLIGIAARLDPVKQIDIAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVRSGWRLPANSEQTR

SEQ ID NO: 46 - protein, 384 aa, Artificial
  Substituion in SEQ ID NO 35
MASERTVIVFFAGNEVGGAATHLATWAKALKGAQVDYRYRFVSLGDGPLADELRQMGMLHGAVAGTVGAIRDLARVLRRERAWILHSHGPRMNMLASFAASSAGAIWTATIHSHPRYDFEGHPLKAALFPSLHLWRLSRARGLFVVQPALGDALPCRTIIEVPNAFFPRLPRASRDVCAAEWRRRLGLNPESRLIGIAARLDPVKQIDVAIAALALLSDLDVHLLVAGDGRDRIRLEAAAEDCGVRHRVHFLGHLQDVRDLYCAIDVHVLPSKSEGAPTSMLEAGYYGAANIGSDVPGIRRMLLDGEAGALVPSGDVQALAHAVRRLLTDTKARDAYVERFQRLVLPRYRPERMVVAYERGYTVIEEDAVRSGWRLPANSEQTR

SEQ ID NO: 47 - DNA, 1155 bp, Artificial
  Substituion in SEQ ID NO 36
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccataaaagatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 48 - DNA, 1155 bp, Artificial
  Substituion in SEQ ID NO 36
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggatgactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 49 - DNA, 1155 bp, Artificial
  Substituion in SEQ ID NO 36
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagaagcggtgcgaagtggctggaggcttccggcgaactctgaacagacgaggtga

SEQ ID NO: 50 - DNA, 1155 bp, Artificial
  Substituion in SEQ ID NO 36
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcctcgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacattgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 51 - DNA, 1155 bp, Artificial
  Substituion in SEQ ID NO 36
ttggcttcggagcgcaccgtgatcgtattttttgcgggaaacgaagtggggggcgctgcgacgcacctcgcgacctgggcgaaggcgctgaagggcgcgcaggtcgactaccgctaccgctttgtcagcttgggcgacggaccgcttgcggacgaactgcggcagatggggatgttgcacggcgcggtcgcagggacggttggcgccatacgcgatttggctcgtgtgctccgacgcgagcgcgcgtggattctccactcgcacggaccgcgcatgaatatgctcgcatcgttcgccgcatcgagtgcgggggccatctggaccgctacgattcacagccatcctcgatacgacttcgaggggcaccccttgaaagccgccttgtttcccagcctccatctgtggcgcctgtctcgtgcgcgcggcctgtttgtggttcagcccgcgctcggagacgcccttccctgccggaccatcattgaggttcccaatgcgttttttccgcggctacccagggcttcgcgcgacgtgtgcgcagccgaatggcgacgtcggctgggcctgaacccagaatcgaggctgatcggcatcgcggcccggctcgatccggtcaaacagatcgacgtcgccatcgccgccctggcgcttctctcagacctggacgttcatctgcttgtcgcgggcgacgggcgagatcgtatccggttagaagcggcagcggaggactgcggcgtgcgccatcgggttcactttttggggcatttgcaggatgtgcgcgatttgtattgcgccatcgacgtccacgtgttgccctcgaagagcgaaggagctcccacctccatgttggaggccggttattacggggccgcgaacatcgggtcggacgtaccgggcattcggcggatgctgctcgacggagaggctggcgcgcttgtgccgtctggcgatgtgcaggcccttgctcatgcggtgcggcgacttctcacggacaccaaggcgcgggacgcctacgtggaacggtttcagcggctcgtgcttccgaggtataggccggaacgcatggtcgtcgcgtacgagcgcggctacacggtaatcgaggaagatgcggtgcgaagtggctggaggcttccggcgaactctgaacagacgaggtga

SEQ ID NO: 52 - protein, 384 aa, Alicyclobacillus acidocaldarius
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAVRAFHVDEKVSEYEALYREVMAAERGEHAHPRPGA

SEQ ID NO: 53 - DNA, 1155 bp, Alicyclobacillus acidocaldarius
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccgtgcgagcgtttcatgtggatgagaaggtcagcgagtacgaggctttgtatcgcgaggtgatggcggctgaacgcggcgagcatgcgcatccccgccccggcgcgtga

SEQ ID NO: 54 - protein, 370 aa, Paenibacillus larvae subsp. larvae BRL-230010
LKIGITCYPSLGGSGVVATELGKLLAEQGHEVHFIAHSMPFRLGRFDKNVFYHEVEVSDYYVFKYPPYDLSLASKLAQVARMQELDLLHVHYAIPHAVCALLAKQMVGDHLKVVTTLHGTDITVLAQDASISNMIRFAINESDAVTAVSEDLIRETRQTLDIQKPIHKIYNFVDKRMYYPRPVEDLKREVTRPGEKLFIHISNFRPVKRVHDVVQIFARVHREIPSRLLLVGEGLELSRIVSEVRELGLQDFVEFWGKQDDVAQVISLADVMLLPSEKESFGLVALEAMACGVPTVGSNAGGIPELITHGETGFMAEVGDVDTMSKYTIRLLEDEELLKRVSEACVQRARKKFCNDSLRARYEQVYYEVL

SEQ ID NO: 55 - protein, 374 aa, Bacillus pumilus SAFR-032
LKVGITCYPSVGGSGIIATELGKRLAEKGHDVHFITSSIPFRLNKVYPNIYFHEVDVNQYAVFQYPPYDLALASKLAEVARREKLDIIHAHYAVPHAVCAYLAKQMTGHSVKVVTTLHGTDITVLGYDPSLKEVIRFAIESSDRVTAVSHSLAAQTYDLIKPNKKIETIHNFVDERVYLRDDHNVLKRHYGLLDHEKVVIHVSNFRKVKRVHDVIHVFKKISEQVNAKLLLIGDGPEKSVVCELVKKLGLTDRVLFLGKQEKVEELYSISDLKLLLSEKESFGLVLLEAMACGVPCIGTDVGGIPEVITHGETGFLVPLGDIDAAAKHAVSILKDKALHEQVSAAAQSSVQAHFSSEKIVSEYEELYLELIEGD

SEQ ID NO: 56 - protein, 371 aa, Bacillus sp. NRRL B-14911
LKIGITCYPTVGGSGVVATELGKLLAERGHEIHFISSSLPFRLNRMYHNIFYHQVEVSQYSVFQYPPYDIALASKMAEVINREKLDLMHVHYAVPHAVCAILAKQMSGRDVKIATTLHGTDITVLGYEPSLKDSIRFGIEKSDRVTAVSKSLISQTNELIHPEKEIQAVYNFIDHRVYQKTGSDHLKKEYGITEDEKTVIHVSNFRAVKRVQDVVKVFARIESEMPAKLLLVGDGPEMSNVCKLVKELGLKEKVLFLGKQDKVEELYSISDLMLLLSEKESFGLVALEAMACGVPCIGTNIGGIPEVISDGETGYICKLGDIGSMAEKAAGLLADADKHTSFSHRAVQTAREKFSAEQIVSEYERLYFDML

SEQ ID NO: 57 - protein, 375 aa, Bacillus cereus ATCC 14579
LKIGITCYPSVGGSGVVGTELGKQLAERGHEIHFITSGLPFRLNKVYPNIYFHEVTVNQYSVFQYPPYDLALASKMAEVAQRENLDILHVHYAIPHAICAYLAKQMIGERIKIVTTLHGTDITVLGSDPSLNNLIRFGIEQSDVVTAVSHSLINETHELVKPSKEIQTVYNFIDERVYFKRNMSQLKKEYGISESEKVLIHISNFRKVKRVQDVVQAFAKIVKEVDAKLLLVGDGPEFCTILQIVKNLHIEDRVLFLGKQDNVAELLAMSDLMLLLSEKESFGLVLLEAMACGVPCIGTRVGGIPEVIQHGETGYLCEVGDTTGVANQAIQLLKDEELHRNMGERARESVYEQFRSEKIVSQYETIYYDVLRDDK

SEQ ID NO: 58 - protein, 375 aa, Bacillus anthracis str. Ames
LKIGITCYPSVGGSGVVGTELGKQLAERGHEIHFITSGLPFRLNKVYPNIYFHEVTVNQYSVFQYPPYDLALASKMAEVAQRENLDILHVHYAIPHAICAYLAKQMIGERIKIVTTLHGTDITVLGSDPSLNNLIRFGIEQSDVVTAVSHSLINETHELVKPNKDIQTVYNFIDERVYFKRDMTQLKKEYGISESEKILIHISNFRKVKRVQDVVQAFAKIVTEVDAKLLLVGDGPEFCTILQLVKNLHIEDRVLFLGKQDNVAELLAMSDLMLLLSEKESFGLVLLEAMACGVPCIGTRVGGIPEVIQHGDTGYLCEVGDTTGVADQAIQLLKDEELHRNMGERARESVYEQFRSEKIVSQYETIYYDVLRDDK

SEQ ID NO: 59 - protein, 384 aa, Artificial
  Substituion in SEQ ID NO 52
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGDLKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAVRAFHVDEKVSEYEALYREVMAAERGEHAHPRPGA

SEQ ID NO: 60 - protein, 384 aa, Artificial
  Substituion in SEQ ID NO 52
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAIRAFHVDEKVSEYEALYREVMAAERGEHAHPRPGA

SEQ ID NO: 61 - protein, 384 aa, Artificial
  Substituion in SEQ ID NO 52
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSLIKLGIERSDAVTAVSQSLVRDTARLFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAVRAFHVDEKVSEYEALYREVMAAERGEHAHPRPGA

SEQ ID NO: 62 - protein, 384 aa, Artificial
  Substituion in SEQ ID NO 52
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARLFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDDATYRAFSARARERAVRAFHVDEKVSEYEALYREVMAAERGEHAHPRPGA

SEQ ID NO: 63 - protein, 384 aa, Artificial
  Substituion in SEQ ID NO 52
MRVGISCYPTVGGSGAVATELGKALARRGHEVHFIVTDVPFRLGAFVEHVYIHQIEPITYPVLKTPPYDFALASLMARVADEYQLDVLHAHYALPFAVCAHLAREMAKHPIRVVTTLHGTDITVLAQDPSLKSIIKLGIERSDAVTAVSQSLVRDTARIFETDKPIRCIYNFVDPDVFRPGCGGELKRHFAPNGERVLLHISNFRPVKRLHDVIAVFERVARRMPAKLLLVGEGPDLGAAKRQVEEAGLGDRVHFLGRQDEVAPLFAAADLFLLPSESESFGLVALEAMSCGVPVVGSTAGGIPEVVVHGETGFLAPVGRVDDMADLACKLLQDEATYRAFSARARERAVRAFHVDEKVSEYEALYREVMAAERGEHAHPRPGA

SEQ ID NO: 64 - DNA, 1155 bp, Artificial
  Substituion in SEQ ID NO 53
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggatctgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccgtgcgagcgtttcatgtggatgagaaggtcagcgagtacgaggctttgtatcgcgaggtgatggcggctgaacgcggcgagcatgcgcatccccgccccggcgcgtga

SEQ ID NO: 65 - DNA, 1155 bp, Artificial
  Substituion in SEQ ID NO 53
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccattcgagcgtttcatgtggatgagaaggtcagcgagtacgaggctttgtatcgcgaggtgatggcggctgaacgcggcgagcatgcgcatccccgccccggcgcgtga

SEQ ID NO: 66 - DNA, 1155 bp, Artificial
  Substituion in SEQ ID NO 53
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccttaatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccgtgcgagcgtttcatgtggatgagaaggtcagcgagtacgaggctttgtatcgcgaggtgatggcggctgaacgcggcgagcatgcgcatccccgccccggcgcgtga

SEQ ID NO: 67 - DNA, 1155 bp, Artificial
  Substituion in SEQ ID NO 53
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcttgttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgatgccacgtaccgggcgttctccgcgcgagcccgcgagcgagccgtgcgagcgtttcatgtggatgagaaggtcagcgagtacgaggctttgtatcgcgaggtgatggcggctgaacgcggcgagcatgcgcatccccgccccggcgcgtga

SEQ ID NO: 68 - DNA, 1155 bp, Artificial
  Substituion in SEQ ID NO 53
ttgcgcgtgggtatcagctgttatccgacggtgggcggatccggagcggtggccaccgagcttggcaaggcgctcgcgcggcggggacacgaggtgcacttcatcgtgaccgacgtgccgttccggctcggcgcgtttgtggaacacgtgtacattcaccaaatcgagcccatcacgtacccggtcctcaagaccccgccgtacgactttgcgctcgccagtctcatggcgcgcgtggccgatgaataccaactcgacgtgctgcacgcgcactacgcccttccgtttgcggtgtgtgcacacctggcgcgcgagatggcgaagcatcccatccgggtggtcaccaccttgcatggcacggacatcacggtgttggcccaggatccgagcctcaagtccatcatcaaactcggcatcgagcgcagcgacgcggtgacggccgtcagccagagcctggtccgggacacggcacgcattttcgagacggacaaaccgattcgctgcatctacaacttcgtcgatcccgacgtgtttcggcccgggtgcggcggggaactgaagcgccacttcgcgccaaacggcgagcgcgttctgcttcacatctccaacttccgcccggtcaaacggcttcacgacgtgatcgccgtgtttgagcgcgtggcgagacgcatgccggcgaagctgctcctcgtcggcgaagggccggatctgggagcggccaaacgccaggtggaggaggcgggtctcggcgatcgcgtgcattttttggggcgccaggacgaggtggcgccgctttttgcggccgccgatctgttcctgctgccttccgaaagcgagagcttcggcctcgtcgcgctcgaggcgatgtcttgcggcgtgcccgttgtcggatcgacggccggcggcattccggaggtggttgtgcacggggagaccggctttctcgcgcccgtcggccgcgtcgacgacatggcggatctcgcctgtaagcttttgcaagacgaggccacgtaccgggcgttctccgcgcgagcccgcgagcgagccgtgcgagcgtttcatgtggatgagaaggtcagcgagtacgaggctttgtatcgcgaggtgatggcggctgaacgcggcgagcatgcgcatccccgccccggcgcgtga

SEQ ID NO: 69 - protein, 398 aa, Alicyclobacillus acidocaldarius
MTALAWAAAVSLAAWIFLLFGRGFYWRTALSMNTARMAAEARAPRAWPAVWAVVPARNEADVLPRTLPTLLSQAYPGEFHVVLVDDHSTDGTAEVAERLASELRLAHRLRVVRADALPPGWAGKVWAMQNGLRHVPDDAAYVLFTDADISHSPTSVQALVARAERDGLDLVSLMVRLRAESAWEKLLIPAFVYFFAKLYPFAWVAHPRRRTAAAAGGCVLVRRRLLPTPPGLEAIRDAVIDDCALARLVADGGGRLWLGLGDDVVSVRAYGTLGEIWRMIARTAFVQLRFSTVLLLGTALGMLLLYAVPPAAAIAGLVGLLAGAPGSLAALCLGGLAYAILASTFVPMLRWYRLSPARSALLPLAGVLYTLMTLDSARRFWLRTGDHWKGRPYEMRRP

SEQ ID NO: 70 - DNA, 1197 bp, Alicyclobacillus acidocaldarius
atgacggcgctggcttgggccgcggccgtaagcctcgcggcgtggatcttcctgcttttcgggcgcggcttctattggcgcacggcgctctccatgaacaccgcaaggatggcggccgaggccagggcgccccgcgcgtggccggccgtgtgggccgtggtgcccgcgcgcaacgaggcggacgtcttgccgaggacgcttccgacgcttctctcgcaggcgtaccccggtgagttccacgtcgtgctcgtggacgatcacagcacagacggcacggcggaggtggccgagcgccttgcgtcggagcttaggctcgcgcatcgtctgcgcgtggtgcgcgcggatgcgcttccgcctgggtgggcgggcaaggtgtgggccatgcagaatggtctcaggcacgtgccggacgatgcggcgtacgtgctgttcacggacgcggacatctcgcattcaccgacgagcgtccaggccctcgtggcgcgggccgagcgagacgggttggacctcgtctcgctcatggttcggctcagggccgagagcgcatgggaaaagctcctcattccagcgttcgtctacttcttcgcgaagctgtacccgttcgcgtgggtcgctcaccctaggcgaaggaccgcggccgcggcgggcggatgcgtgctcgtcaggcgccgcctgttgcccacgcccccggggcttgaggccattcgcgacgccgtgatcgacgactgtgcgctcgctcggctcgtggcggatggcggcgggcgcctctggctcgggcttggcgacgacgtggtgagcgtgcgggcgtacggaaccctcggcgaaatctggcggatgattgcgcgcaccgcgttcgtgcagctgcggttctccaccgtgctcctcttgggcaccgccctcggcatgctcctcttgtacgccgtgccacccgctgccgcaatcgccggcctcgtgggtcttctggcgggcgcgccggggagcctcgccgctttgtgccttggcgggctcgcgtacgccatcctcgcctcgaccttcgtgccgatgctccggtggtaccgcctgtctccggcgcgatccgccctgcttcccttggccggcgtcctgtacaccctcatgaccctcgactccgccaggcggttctggctccgcacgggcgatcactggaagggtcggccgtacgaaatgcgccgcccgtga

SEQ ID NO: 71 - protein, 341 aa, Acaryochloris marina MBIC11017
NEAEVLPVSLRSLLQQTYPGPFKILLIDDQSTDQTREIAQQIATDLDRNHQLQVIQTAPLPPGWSGKLWAMHQGIEMVLAESTQPTYFLLTDADIQHEANSLLSLVTKAEQEDQDMVSLMVRLRCQSIWEQLLIPAFVFFFQKLYPFLWVNQPQKQMAAAAGGCILVRRQTLSTIGGIQVIRDALIDDCALAAAIKQTPNAQPNRNIWLGLTSATQSLRSYDTLDSIWSMVARTAFTQLNYSTLLLIGTVVGMFLIYMVPPISIMLGLYLESISITVTGLITWVLMTLAYLPTIRLYQLSPIWAVSLPLIALLYNLMTLDSARQHWQGKGGAWKGRVYPAR

SEQ ID NO: 72 - protein, 370 aa, Frankia alni ACN14a
LYLAVGHGFFWRTDQRLPARQAPPSWPSVAIIIPARDEADVLPVTLPTLLAQDYPGPVRLILVDDGSTDGTTEVARALAEQAARNGHTGVTAAVTASTEPPPGWTGKLWALRRGVDCAGDAEFLLLTDADIAHDPGSLTSLVASARTHGLDMVSQMAVLRAETVWERVIVPAFVYFFAMLYPFRWSNRPRSRVAAAAGGCSLVRREALLAAGGLAEVRGAVIDDVAIARIIKRSGGRTWLGLAEQVHSRRPYPRLADLWKMVSRSAYAQLRHSPLLLLGTVLGMSLVFVVPVVATIAGLAAGDGTTAILGAVAWVIMTLSYVPMIRYYRQPVPAALLLPGVAVLYLGMTLDSARLKWAGRGAAWKGRTYD

SEQ ID NO: 73 - protein, 371 aa, Burkholderia pseudomallei 406e
LVLLFGRGGFWRARAARRLPPDARGAAAAAGWPAVAAVVPARNEADVIGEAVRSLVEQAYEGAFHLIVVDDHSTDGTAEAARAAAAAVGCADRLTVLAAQPLPAGWSGKVWAQSQGIAAVRSLGLPADYLLLTDADIGHPPDAVAQLVTRAQAEQRDLVSLMVRLRCDSFWEKALIPAFVFFFAKLYPFSWINDPRNRTAGAAGGCMLVRRDALEEAGGIESIRGALIDDCSLAAQIKHRGAGRHPIRLDLADRSVSLRPYDSWRDIWNMIARTAFTQLRYSPVLLLGTLVGMTILYLVPPVAALAYGARAWPAWLAWASMCTAYAPMLSYYRRSPWWAPALPLVALFYVGATFASAVRYWRGKGGQWKAR

SEQ ID NO: 74 - protein, 371 aa, Burkholderia pseudomallei 1106a
LVLLFGRGGFWRARAARRLPPDARGAAAAAGWPAVATVVPARNEADVIGEAVRSLVEQAYEGAFHLIVVDDHSTDGTAEAARAAAAAVGCADRLTVLAAQPLPAGWSGKVWAQSQGIAAVRSLGLPADYLLLTDADIGHPPDAVAQLVTRAQAEQRDLVSLMVRLRCDSFWEKALIPAFVFFFAKLYPFSWINDPRNRTAGAAGGCMLVRRDALEEAGGIESIRGALIDDCSLAAQIKHRGAGRHPIRLDLADRSVSLRPYDSWRDIWNMIARTAFTQLRYSPVLLLGTLVGMTILYLVPPVAALAYGARAWPAWLAWASMCTAYAPMLSYYRRSPWWAPALPLVALFYVGATFASAVRYWRGKGGQWKAR

SEQ ID NO: 75 - protein, 371 aa, Burkholderia pseudomallei 1710b; identical to SEQ ID NO: 73

SEQ ID NO: 76 - protein, 398 aa, Artificial
  Substituion in SEQ ID NO 69
MTALAWAAAVSLAAWIFLLFGRGFYWRTALSMNTARMAAEARAPRAWPAVWAVVPARNEADVLPRTLPTLLSQAYPGEFHVVLVDDHSTDGTAEVAERLASELRLAHRLRVVRADALPPGWAGKVWAMQNGLRHVPDDAAYVLFTDADISHSPTSVQALVARAERDGLDLVSLMVRLRAESAWEKLLIPAFVYFFAKLYPFAWVAHPRKRTAAAAGGCVLVRRRLLPTPPGLEAIRDAVIDDCALARLVADGGGRLWLGLGDDVVSVRAYGTLGEIWRMIARTAFVQLRFSTVLLLGTALGMLLLYAVPPAAAIAGLVGLLAGAPGSLAALCLGGLAYAILASTFVPMLRWYRLSPARSALLPLAGVLYTLMTLDSARRFWLRTGDHWKGRPYEMRRP

SEQ ID NO: 77 - protein, 398 aa, Artificial
  Substituion in SEQ ID NO 69
MTALAWAAAVSLAAWIFLLFGRGFYWRTALSMNTARMAAEARAPRAWPAVWAVVPARNEADVLPRTLPTLLSQAYPGEFHVVLVDDHSTDGTAEVAERLASELRLAHRLRVVRADALPPGWAGKVWAMQNGLRHVPDDAAYVLFTDADISHSPTSVQALVARAERDGLDLVSLMVRLRAESAWEKLLIPAFVYFFAKLYPFAWVAHPRRRTAAAAGGCVLVRRRLLPTPPGLEAIRDAVIDDCALARLVADGGGRLWLGLGDDVVSVRAYGTLGEIWRMIARTAFVQLRFSTVLLLGTALGMLLLYAVPPAAAIAGLVGLLAGAPGSLAALCLGGLAYAILASTFVPMLRWYRLSPARSALLPLAGVLYTLMTLDSARRFWLRTGDHWKGRPYDMRRP

SEQ ID NO: 78 - protein, 398 aa, Artificial
  Substituion in SEQ ID NO 69
MTALAWAAAVSLAAWIFLLFGRGFYWRTALSMNTARMAAEARAPRAWPAVWAVVPARNEADVLPRTLPTLLSQAYPGEFHVVLVDDHSTDGTAEVAERLASELRLAHRLRVVRADALPPGWAGKVWAMQNGLRHVPDDAAYVLFTDADISHSPTSVQALVARAERDGLDLVSLMVRLRAESAWEKLLIPAFVYFFAKLYPFAWVAHPRRRTAAAAGGCVLVRRRLLPTPPGLEAIRDAVIDDCALARLVADGGGRIWLGLGDDVVSVRAYGTLGEIWRMIARTAFVQLRFSTVLLLGTALGMLLLYAVPPAAAIAGLVGLLAGAPGSLAALCLGGLAYAILASTFVPMLRWYRLSPARSALLPLAGVLYTLMTLDSARRFWLRTGDHWKGRPYEMRRP

SEQ ID NO: 79 - protein, 398 aa, Artificial
  Substituion in SEQ ID NO 69
MTALAWAAAVSLAAWIFLLFGRGFYWRTALSMNTARMAAEARAPRAWPAVWAVVPARNEADVLPRTLPTLLSQAYPGEFHVVLVDDHSTDGTAEVAERLASELRLAHRLRVVRADALPPGWAGKVWAMQNGLRHVPDEAAYVLFTDADISHSPTSVQALVARAERDGLDLVSLMVRLRAESAWEKLLIPAFVYFFAKLYPFAWVAHPRRRTAAAAGGCVLVRRRLLPTPPGLEAIRDAVIDDCALARLVADGGGRLWLGLGDDVVSVRAYGTLGEIWRMIARTAFVQLRFSTVLLLGTALGMLLLYAVPPAAAIAGLVGLLAGAPGSLAALCLGGLAYAILASTFVPMLRWYRLSPARSALLPLAGVLYTLMTLDSARRFWLRTGDHWKGRPYEMRRP

SEQ ID NO: 80 - protein, 398 aa, Artificial
  Substituion in SEQ ID NO 69
MTALAWAAAVSLAAWIFLLFGRGFYWRTALSMNTARMAAEARAPRAWPAVWAVVPARNEADVLPRTLPTLLSQAYPGEFHVVLVDDHSTDGTAEVAERLASELRLAHRLRVVRADALPPGWAGKVWAMQNGLRHVPDDAAYVLFTDADISHSPTSVQALVARAERDGLDLVSLMVRLRAESAWEKLLIPAFVYFFAKLYPFAWVAHPRRRTAAAAGGCVLVRRRLLPTPPGLEAIRDAVIDDCALARIVADGGGRLWLGLGDDVVSVRAYGTLGEIWRMIARTAFVQLRFSTVLLLGTALGMLLLYAVPPAAAIAGLVGLLAGAPGSLAALCLGGLAYAILASTFVPMLRWYRLSPARSALLPLAGVLYTLMTLDSARRFWLRTGDHWKGRPYEMRRP

SEQ ID NO: 81 - DNA, 1197 bp, Artificial
  Substituion in SEQ ID NO 70
atgacggcgctggcttgggccgcggccgtaagcctcgcggcgtggatcttcctgcttttcgggcgcggcttctattggcgcacggcgctctccatgaacaccgcaaggatggcggccgaggccagggcgccccgcgcgtggccggccgtgtgggccgtggtgcccgcgcgcaacgaggcggacgtcttgccgaggacgcttccgacgcttctctcgcaggcgtaccccggtgagttccacgtcgtgctcgtggacgatcacagcacagacggcacggcggaggtggccgagcgccttgcgtcggagcttaggctcgcgcatcgtctgcgcgtggtgcgcgcggatgcgcttccgcctgggtgggcgggcaaggtgtgggccatgcagaatggtctcaggcacgtgccggacgatgcggcgtacgtgctgttcacggacgcggacatctcgcattcaccgacgagcgtccaggccctcgtggcgcgggccgagcgagacgggttggacctcgtctcgctcatggttcggctcagggccgagagcgcatgggaaaagctcctcattccagcgttcgtctacttcttcgcgaagctgtacccgttcgcgtgggtcgctcaccctaggaaaaggaccgcggccgcggcgggcggatgcgtgctcgtcaggcgccgcctgttgcccacgcccccggggcttgaggccattcgcgacgccgtgatcgacgactgtgcgctcgctcggctcgtggcggatggcggcgggcgcctctggctcgggcttggcgacgacgtggtgagcgtgcgggcgtacggaaccctcggcgaaatctggcggatgattgcgcgcaccgcgttcgtgcagctgcggttctccaccgtgctcctcttgggcaccgccctcggcatgctcctcttgtacgccgtgccacccgctgccgcaatcgccggcctcgtgggtcttctggcgggcgcgccggggagcctcgccgctttgtgccttggcgggctcgcgtacgccatcctcgcctcgaccttcgtgccgatgctccggtggtaccgcctgtctccggcgcgatccgccctgcttcccttggccggcgtcctgtacaccctcatgaccctcgactccgccaggcggttctggctccgcacgggcgatcactggaagggtcggccgtacgaaatgcgccgcccgtga

SEQ ID NO: 82 - DNA, 1197 bp, Artificial
  Substituion in SEQ ID NO 70
atgacggcgctggcttgggccgcggccgtaagcctcgcggcgtggatcttcctgcttttcgggcgcggcttctattggcgcacggcgctctccatgaacaccgcaaggatggcggccgaggccagggcgccccgcgcgtggccggccgtgtgggccgtggtgcccgcgcgcaacgaggcggacgtcttgccgaggacgcttccgacgcttctctcgcaggcgtaccccggtgagttccacgtcgtgctcgtggacgatcacagcacagacggcacggcggaggtggccgagcgccttgcgtcggagcttaggctcgcgcatcgtctgcgcgtggtgcgcgcggatgcgcttccgcctgggtgggcgggcaaggtgtgggccatgcagaatggtctcaggcacgtgccggacgatgcggcgtacgtgctgttcacggacgcggacatctcgcattcaccgacgagcgtccaggccctcgtggcgcgggccgagcgagacgggttggacctcgtctcgctcatggttcggctcagggccgagagcgcatgggaaaagctcctcattccagcgttcgtctacttcttcgcgaagctgtacccgttcgcgtgggtcgctcaccctaggcgaaggaccgcggccgcggcgggcggatgcgtgctcgtcaggcgccgcctgttgcccacgcccccggggcttgaggccattcgcgacgccgtgatcgacgactgtgcgctcgctcggctcgtggcggatggcggcgggcgcctctggctcgggcttggcgacgacgtggtgagcgtgcgggcgtacggaaccctcggcgaaatctggcggatgattgcgcgcaccgcgttcgtgcagctgcggttctccaccgtgctcctcttgggcaccgccctcggcatgctcctcttgtacgccgtgccacccgctgccgcaatcgccggcctcgtgggtcttctggcgggcgcgccggggagcctcgccgctttgtgccttggcgggctcgcgtacgccatcctcgcctcgaccttcgtgccgatgctccggtggtaccgcctgtctccggcgcgatccgccctgcttcccttggccggcgtcctgtacaccctcatgaccctcgactccgccaggcggttctggctccgcacgggcgatcactggaagggtcggccgtacgatatgcgccgcccgtga

SEQ ID NO: 83 - DNA, 1197 bp, Artificial
  Substituion in SEQ ID NO 70
atgacggcgctggcttgggccgcggccgtaagcctcgcggcgtggatcttcctgcttttcgggcgcggcttctattggcgcacggcgctctccatgaacaccgcaaggatggcggccgaggccagggcgccccgcgcgtggccggccgtgtgggccgtggtgcccgcgcgcaacgaggcggacgtcttgccgaggacgcttccgacgcttctctcgcaggcgtaccccggtgagttccacgtcgtgctcgtggacgatcacagcacagacggcacggcggaggtggccgagcgccttgcgtcggagcttaggctcgcgcatcgtctgcgcgtggtgcgcgcggatgcgcttccgcctgggtgggcgggcaaggtgtgggccatgcagaatggtctcaggcacgtgccggacgatgcggcgtacgtgctgttcacggacgcggacatctcgcattcaccgacgagcgtccaggccctcgtggcgcgggccgagcgagacgggttggacctcgtctcgctcatggttcggctcagggccgagagcgcatgggaaaagctcctcattccagcgttcgtctacttcttcgcgaagctgtacccgttcgcgtgggtcgctcaccctaggcgaaggaccgcggccgcggcgggcggatgcgtgctcgtcaggcgccgcctgttgcccacgcccccggggcttgaggccattcgcgacgccgtgatcgacgactgtgcgctcgctcggctcgtggcggatggcggcgggcgcatttggctcgggcttggcgacgacgtggtgagcgtgcgggcgtacggaaccctcggcgaaatctggcggatgattgcgcgcaccgcgttcgtgcagctgcggttctccaccgtgctcctcttgggcaccgccctcggcatgctcctcttgtacgccgtgccacccgctgccgcaatcgccggcctcgtgggtcttctggcgggcgcgccggggagcctcgccgctttgtgccttggcgggctcgcgtacgccatcctcgcctcgaccttcgtgccgatgctccggtggtaccgcctgtctccggcgcgatccgccctgcttcccttggccggcgtcctgtacaccctcatgaccctcgactccgccaggcggttctggctccgcacgggcgatcactggaagggtcggccgtacgaaatgcgccgcccgtga

SEQ ID NO: 84 - DNA, 1197 bp, Artificial
  Substituion in SEQ ID NO 70
atgacggcgctggcttgggccgcggccgtaagcctcgcggcgtggatcttcctgcttttcgggcgcggcttctattggcgcacggcgctctccatgaacaccgcaaggatggcggccgaggccagggcgccccgcgcgtggccggccgtgtgggccgtggtgcccgcgcgcaacgaggcggacgtcttgccgaggacgcttccgacgcttctctcgcaggcgtaccccggtgagttccacgtcgtgctcgtggacgatcacagcacagacggcacggcggaggtggccgagcgccttgcgtcggagcttaggctcgcgcatcgtctgcgcgtggtgcgcgcggatgcgcttccgcctgggtgggcgggcaaggtgtgggccatgcagaatggtctcaggcacgtgccggacgaagcggcgtacgtgctgttcacggacgcggacatctcgcattcaccgacgagcgtccaggccctcgtggcgcgggccgagcgagacgggttggacctcgtctcgctcatggttcggctcagggccgagagcgcatgggaaaagctcctcattccagcgttcgtctacttcttcgcgaagctgtacccgttcgcgtgggtcgctcaccctaggcgaaggaccgcggccgcggcgggcggatgcgtgctcgtcaggcgccgcctgttgcccacgcccccggggcttgaggccattcgcgacgccgtgatcgacgactgtgcgctcgctcggctcgtggcggatggcggcgggcgcctctggctcgggcttggcgacgacgtggtgagcgtgcgggcgtacggaaccctcggcgaaatctggcggatgattgcgcgcaccgcgttcgtgcagctgcggttctccaccgtgctcctcttgggcaccgccctcggcatgctcctcttgtacgccgtgccacccgctgccgcaatcgccggcctcgtgggtcttctggcgggcgcgccggggagcctcgccgctttgtgccttggcgggctcgcgtacgccatcctcgcctcgaccttcgtgccgatgctccggtggtaccgcctgtctccggcgcgatccgccctgcttcccttggccggcgtcctgtacaccctcatgaccctcgactccgccaggcggttctggctccgcacgggcgatcactggaagggtcggccgtacgaaatgcgccgcccgtga

SEQ ID NO: 85 - DNA, 1197 bp, Artificial
  Substituion in SEQ ID NO 70
atgacggcgctggcttgggccgcggccgtaagcctcgcggcgtggatcttcctgcttttcgggcgcggcttctattggcgcacggcgctctccatgaacaccgcaaggatggcggccgaggccagggcgccccgcgcgtggccggccgtgtgggccgtggtgcccgcgcgcaacgaggcggacgtcttgccgaggacgcttccgacgcttctctcgcaggcgtaccccggtgagttccacgtcgtgctcgtggacgatcacagcacagacggcacggcggaggtggccgagcgccttgcgtcggagcttaggctcgcgcatcgtctgcgcgtggtgcgcgcggatgcgcttccgcctgggtgggcgggcaaggtgtgggccatgcagaatggtctcaggcacgtgccggacgatgcggcgtacgtgctgttcacggacgcggacatctcgcattcaccgacgagcgtccaggccctcgtggcgcgggccgagcgagacgggttggacctcgtctcgctcatggttcggctcagggccgagagcgcatgggaaaagctcctcattccagcgttcgtctacttcttcgcgaagctgtacccgttcgcgtgggtcgctcaccctaggcgaaggaccgcggccgcggcgggcggatgcgtgctcgtcaggcgccgcctgttgcccacgcccccggggcttgaggccattcgcgacgccgtgatcgacgactgtgcgctcgctcggattgtggcggatggcggcgggcgcctctggctcgggcttggcgacgacgtggtgagcgtgcgggcgtacggaaccctcggcgaaatctggcggatgattgcgcgcaccgcgttcgtgcagctgcggttctccaccgtgctcctcttgggcaccgccctcggcatgctcctcttgtacgccgtgccacccgctgccgcaatcgccggcctcgtgggtcttctggcgggcgcgccggggagcctcgccgctttgtgccttggcgggctcgcgtacgccatcctcgcctcgaccttcgtgccgatgctccggtggtaccgcctgtctccggcgcgatccgccctgcttcccttggccggcgtcctgtacaccctcatgaccctcgactccgccaggcggttctggctccgcacgggcgatcactggaagggtcggccgtacgaaatgcgccgcccgtga

SEQ ID NO: 86 - protein, 526 aa, Alicyclobacillus acidocaldarius
MDPNGRFASWGRTPIDVRVVSKHVEIGFPRLPMMRYTFLGSSRRIAGGPMFRTYQELFRRIFIATDAAIVVVSFLLAWWLKFDSGWIPHAGHLPLLYYRGPLLIAVIVFVLANGVARLYEPMRAKSLFYEAYSVAKGVILGTIVLMAALYFAKMQEFSRDVIALFTGINFGLMVGERIVVRSVLRSLRRRGLNQRFLLIVGWSAATRRFLEALEAQPWFGYRVIGYLRYEGDDASRATVPCIGAVDDIRCVLEEHLVDQVVIAAPRDRVGDLAEVISACEAVGVQSLILPDYFDLLPARPRFETFGDVPLIDTRHVPLDDAVNAFLKRAFDIVFSLGVLIGLSPLLVAIAIAVKLSSPGPVLYVQERVGKNRRTFKMYKFRTMYWDPGADRAERDCAEEADLRSAGWTVKGDPRRTRVGAFLRRTSLDELPQFWNVLKGDMSVIGPRPERPVFVERFREEVPRYMVKHRVRPGITGWAQVHGWRGDTSIAERIRFDIEYIENWSFWLDLKIVWKTIKHGFVNENAY

SEQ ID NO: 87 - DNA, 1581 bp, Alicyclobacillus acidocaldarius
atggacccgaacggtaggtttgcaagttggggaagaacgcccatcgacgtaagggtggtgtcaaaacatgtcgaaataggcttccctcgcttgccaatgatgcgctatactttccttggtagttcacgccgcatcgcgggtggtcctatgtttcgcacttatcaggagctgttccggcgaatcttcatcgctaccgacgcggccatcgtcgtcgtgagttttctactcgcatggtggctcaagtttgattctgggtggattccgcacgccggccatctcccactcctctattatcgagggccgcttctcatcgccgtgatcgtattcgtgcttgcaaacggtgtagcgcggctctacgaaccgatgcgcgcgaagagcttgttctacgaggcgtacagcgtagcgaagggcgtcatcctcgggacaattgtcctcatggctgccctctatttcgcgaagatgcaggagttttcgcgagacgtcatcgcgctctttactggcatcaacttcgggctcatggtgggagagcggatcgtcgtgcgctccgtgctgcgcagcctgcgccgccgagggttgaatcagcgatttctcctcatcgtgggctggagtgcagcgacgcgtcgcttcctcgaggccctggaggcccagccgtggttcggttaccgtgtcataggctatctccgttacgaaggtgatgatgcgtcgcgcgcgacagtgccatgcatcggggcggttgacgacattcgttgcgtgcttgaggagcacctcgtcgatcaggtggtcatcgcggcaccgcgggatcgagtgggcgatctcgccgaagtgatttccgcctgcgaagctgtaggggtccagtcgctgatcttgccggattacttcgatctcctgccggccaggccccgttttgaaacctttggagatgtgccgctgattgacacgcgccatgtgccgctggacgatgcggtgaacgccttcctgaagcgcgcgttcgacatcgtgttcagtctgggggtcctgattggtctgtcgccgctgttggtggccattgcgattgcggtgaagctttcgtcgccagggccagtgctgtacgtgcaggagcgagtgggcaaaaatcgacggacatttaagatgtacaagttccgaacgatgtactgggatcccggggcggaccgtgcggagcgggattgcgcggaagaggcggacctgcggagcgctggttggacggtgaaaggcgatccgcggcggactcgcgtgggagcgttcctacgtcgcacgagtttggacgagctccctcagttctggaacgtgctgaagggagacatgagcgtcattgggccgcgcccggagcgccccgtcttcgtcgagcgattccgagaagaggtgccgcgttacatggtcaagcaccgcgtgagaccaggtatcaccgggtgggcgcaggtgcatggatggcgcggagatacttcgattgctgaacggattcgatttgacattgagtacatcgaaaactggtcattctggcttgatctcaagattgtgtggaagactatcaaacatgggtttgtgaatgagaatgcgtattga

SEQ ID NO: 88 - protein, 468 aa, Geobacillus stearothermophilus
VIRGRERFLTKLYAFVDFAMMQGAFFLAWVLKFKVFHNGVGGHLPLEDYLFWSFVYGAIAIVIGYLVELYAPKRKEKFSNELAKVLQVHTLSMFVLLSVLFTFKTVDVSRSFLLLYFAWNLILVSIYRYIVKQSLRTLRKKGYNKQFVLIIGAGSIGRKYFENLQMHPEFGLEVVGFLDDFRTKHAPEFAHYKPIIGQTADLEHVLSHQLIDEVIVALPLQAYPKYREIIAVCEKMGVRVSIIPDFYDILPAAPHFEIFGDLPIINVRDVPLDELRNRVLKRSFDIVFSLVAIIVTSPIMLLIAIGIKLTSPGPIIFKQERVGLNRRTFYMYKFRSMKPMPQSVSDTQWTVESDPRRTKFGAFLRKTSLDELPQFFNVLKGDMSIVGPRPERPFFVEKFKKEIPKYMIKHHVRPGITGWAQVCGLRGDTSIQERIEHDLFYIENWSLWLDIKIILLTITNGLVNKNAY

SEQ ID NO: 89 - protein, 459 aa, Geobacillus tepidamans
RGRERFLTKLYAFVDFAMMQGAFFLAWVLKFKVFHDGVGGHLPLEDYWFWSFVYGAIAIVIGYLVELYAPKRKEKFSNELAKVLQVHTLSMFILLSVLFTFKTVDVSRSFLLLYFAWNLTLASIYRYVVKQSLRKLRKKWYNKQFVLIIGAGSIGRKYFENLQMHPEYGLEVVGFLDDFRTKHAPEFAHYKPIIGQTADLEHVLSHQLIDEVIVALPLQAYPKYREIIAVCEKMGVRVSIIPDFYDMLPAVPHFEIFGDLPIINVRDVPLDELRNRILKRSFDVVFSLVAIIVTSPIMLLIAIGIKLTSPGPIIFKQERVGLNRRTFYMYKFRSMKHLPQSVSDTQWTVENDPRRTKFGAFLRKTSLDELPQFFNVLKGDMSVVGPRPERPYFVEKFKEEIPKYMIKHHVRPGITGWAQVCGLRGDTSIKARIEHDIFYIENWSLLFDIKIIFKTISNG

SEQ ID NO: 90 - protein, 463 aa, Desulfitobacterium hafniense DCB-2
MIRENQKTLNMIQVILDLAIVVIALALAYWLRFANYEGSHLKFESYVPTLVLLVPLHFFLYYLLGLYEARRRKSLSFEVGKIIQANFLSTMILFTLLYIIKEIHYSRQVLIYFVIFTGTLTIAERMALRAILNNIREKGYNKKHVLIIGTGRLAKRLVNALQENRYLGYEILGIVGENTAVGKKLAGVTVAGAISDLENIIMESKIDEIFITISTKDYDLFRNIIKICEKSGVRTQIVPDYARFIPAKPQMDEIEGIPLINIRHVPLDNFLKAFAKRVFDVAVSFVGLVVCLPLFLIIIIGIKLDSPGPIIFSQERVGLNKKNFMMYKFRTMKEQSIEESDKEWTTENDDRKTRLGNLLRKTSLDELPQLWNVFKGDMSLVGPRPERPFFVEQFKEKIPRYMVKHHVRPGITGWAQVNGWRGDTSIRKRIECDIYYIENWTFMFDLKILVMTVFKGFVNRNAY

SEQ ID NO: 91 - protein, 463 aa, Desulfitobacterium hafniense Y51
MIRENQKTLNMIQVILDLGIVVIALALAYWYRFSNYEGSYLKFESYVPTLVLLVPLHFFLYYLLGLYEARRRKSFSFEVGKIIQANLLSTMILFTLLYIIKEIDYSRQVLIYFIILTGTLTIAERVALRAILNNIREKGYNKKHVLIIGTGRLAKRLVNALQENRYLGYEILGIVGENTAVGKKLAGVTVAGAISDLENIIMESKIDEIFITISTKEYDLFRNIIKICEKSGVRTQIVPDYARFIPAKPQMDEVDGIPLINIRHVPLDNFLKSFAKRAFDVAVSFVGLIICLPIFLVIIIGIKLDSPGAVIFSQERVGLNKKNFMMYKFRTMRMQSAEESDKEWTTKEDNRKTRLGNILRKTSLDELPQLWNVFKGDMSLVGPRPERPFFVEQFKEKIPRYMIKHHVRPGITGWAQVNGWRGDTSIRKRIECDIYYIENWTFMFDLKILVMTVFKGFVNRNAY

SEQ ID NO: 92 - protein, 462 aa, Dorea formicigenerans ATCC 27755
QKLFNRLHVLIDALIIIFSYGAAWFIRFKSGLFALSSWYLSLSQYMKVLVFVVPIYLILYYAFQLYTPKRGQGRRIEAWHIVQANIIGLLVFILILYLAKMTDYSRKMLFVFFCVNVVAEIGFRNVLRWILRKYRKQGYNQKHILLVGYSRAAEGYLDRVVTHPEWGYIVKGILADNKPEGEEYRGIKILGGTDKLAEILPQNQLDEIVITLGLAEYHKLGRIVNMCEKSGVHTKFVPDYNNIIPTKPYTEDLMGMPVINIRRVPLNNMLNAVAKRCVDILGALVAIILFSPVMLVTSIIIKVTSPGPLIFKQERIGKHNRPFYMYKFRSMVVQDEKDEKKGWTTKNDPRVTPIGRFIRKTSIDELPQLFNILIGDMSLVGPRPERPQFVEKFKEEIPRYMIKHQVRPGLTGWAQVNGYRGDTSIQKRIEFDLYYIENWTMGFDFKIIFLTFFKGFINRNAY

SEQ ID NO: 93 - protein, 526 aa, Artificial
  Substituion in SEQ ID NO 86
MDPNGRFASWGRTPIDVRVVSKHVEIGFPRLPMMRYTFLGSSRRIAGGPMFRTYQELFRRIFIATDAAIVVVSFLLAWWLKFDSGWIPHAGHLPLLYYRGPLLIAVIVFVLANGVARLYEPMRAKSLFYEAYSVAKGVILGTIVLMAALYFAKMQEFSRDVIALFTGINFGLMVGERIVVRSVLRSLRRRGLNQRFLLIVGWSAATRRFLEALEAQPWFGYRVIGYLRYEGDDASRATVPCIGAVDDIKCVLEEHLVDQVVIAAPRDRVGDLAEVISACEAVGVQSLILPDYFDLLPARPRFETFGDVPLIDTRHVPLDDAVNAFLKRAFDIVFSLGVLIGLSPLLVAIAIAVKLSSPGPVLYVQERVGKNRRTFKMYKFRTMYWDPGADRAERDCAEEADLRSAGWTVKGDPRRTRVGAFLRRTSLDELPQFWNVLKGDMSVIGPRPERPVFVERFREEVPRYMVKHRVRPGITGWAQVHGWRGDTSIAERIRFDIEYIENWSFWLDLKIVWKTIKHGFVNENAY

SEQ ID NO: 94 - protein, 526 aa, Artificial
  Substituion in SEQ ID NO 86
MDPNGRFASWGRTPIDVRVVSKHVELGFPRLPMMRYTFLGSSRRIAGGPMFRTYQELFRRIFIATDAAIVVVSFLLAWWLKFDSGWIPHAGHLPLLYYRGPLLIAVIVFVLANGVARLYEPMRAKSLFYEAYSVAKGVILGTIVLMAALYFAKMQEFSRDVIALFTGINFGLMVGERIVVRSVLRSLRRRGLNQRFLLIVGWSAATRRFLEALEAQPWFGYRVIGYLRYEGDDASRATVPCIGAVDDIRCVLEEHLVDQVVIAAPRDRVGDLAEVISACEAVGVQSLILPDYFDLLPARPRFETFGDVPLIDTRHVPLDDAVNAFLKRAFDIVFSLGVLIGLSPLLVAIAIAVKLSSPGPVLYVQERVGKNRRTFKMYKFRTMYWDPGADRAERDCAEEADLRSAGWTVKGDPRRTRVGAFLRRTSLDELPQFWNVLKGDMSVIGPRPERPVFVERFREEVPRYMVKHRVRPGITGWAQVHGWRGDTSIAERIRFDIEYIENWSFWLDLKIVWKTIKHGFVNENAY

SEQ ID NO: 95 - protein, 526 aa, Artificial
  Substituion in SEQ ID NO 86
MDPNGRFASWGRTPIDVRVVSKHVEIGFPRLPMMRYTFLGSSRRIAGGPMFRTYQELFRRIFIATDAAIVVVSFLLAWWLKFDSGWIPHAGHLPLLYYRGPLLIAVIVFVLANGVARLYEPMRAKSLFYEAYSVAKGVILGTIVLMAALYFAKMQEFSRDVIALFTGINFGLMVGERIVVRSVLRSLRRRGLNQRFLLIVGWSAATRRFLEALEAQPWFGYRVIGYLRYEGDDASRATVPCIGAVEDIRCVLEEHLVDQVVIAAPRDRVGDLAEVISACEAVGVQSLILPDYFDLLPARPRFETFGDVPLIDTRHVPLDDAVNAFLKRAFDIVFSLGVLIGLSPLLVAIAIAVKLSSPGPVLYVQERVGKNRRTFKMYKFRTMYWDPGADRAERDCAEEADLRSAGWTVKGDPRRTRVGAFLRRTSLDELPQFWNVLKGDMSVIGPRPERPVFVERFREEVPRYMVKHRVRPGITGWAQVHGWRGDTSIAERIRFDIEYIENWSFWLDLKIVWKTIKHGFVNENAY

SEQ ID NO: 96 - protein, 526 aa, Artificial
  Substituion in SEQ ID NO 86
MDPNGRFASWGRTPIDVRVVSKHVEIGFPRLPMMRYTFLGSSRRIAGGPMFRTYQELFRRIFIATDAAIVVVSFLIAWWLKFDSGWIPHAGHLPLLYYRGPLLIAVIVFVLANGVARLYEPMRAKSLFYEAYSVAKGVILGTIVLMAALYFAKMQEFSRDVIALFTGINFGLMVGERIVVRSVLRSLRRRGLNQRFLLIVGWSAATRRFLEALEAQPWFGYRVIGYLRYEGDDASRATVPCIGAVDDIRCVLEEHLVDQVVIAAPRDRVGDLAEVISACEAVGVQSLILPDYFDLLPARPRFETFGDVPLIDTRHVPLDDAVNAFLKRAFDIVFSLGVLIGLSPLLVAIAIAVKLSSPGPVLYVQERVGKNRRTFKMYKFRTMYWDPGADRAERDCAEEADLRSAGWTVKGDPRRTRVGAFLRRTSLDELPQFWNVLKGDMSVIGPRPERPVFVERFREEVPRYMVKHRVRPGITGWAQVHGWRGDTSIAERIRFDIEYIENWSFWLDLKIVWKTIKHGFVNENAY

SEQ ID NO: 97 - protein, 526 aa, Artificial
  Substituion in SEQ ID NO 86
MDPNGRFASWGRTPIDVRVVSKHVEIGFPRLPMMRYTFLGSSRRIAGGPMFRTYQELFRRIFIATDAAIVVVSFLLAWWLKFDSGWIPHAGHLPLLYYRGPLLIAVIVFVLANGVARLYEPMRAKSLFYEAYSVAKGVILGTIVLMAALYFAKMQEFSRDVIALFTGINFGLMVGERIVVRSVLRSLRRRGLNQRFLLIVGWSAATRRFLEALEAQPWFGYRVIGYLRYEGDDASRATVPCIGAVDDIRCVLEEHLVDQVVIAAPRDRVGDLAEVISACEAVGVQSLILPDYFDLLPARPRFETFGDVPLIDTRHVPLDDAVNAFLKRAFDIVFSLGVLIGLSPLLVAIAIAVKLSSPGPVLYVQERVGKNRRTFKMYKFRTMYWDPGADRAERDCAEEADLKSAGWTVKGDPRRTRVGAFLRRTSLDELPQFWNVLKGDMSVIGPRPERPVFVERFREEVPRYMVKHRVRPGITGWAQVHGWRGDTSIAERIRFDIEYIENWSFWLDLKIVWKTIKHGFVNENAY

SEQ ID NO: 98 - DNA, 1581 bp, Artificial
  Substituion in SEQ ID NO 87
atggacccgaacggtaggtttgcaagttggggaagaacgcccatcgacgtaagggtggtgtcaaaacatgtcgaaataggcttccctcgcttgccaatgatgcgctatactttccttggtagttcacgccgcatcgcgggtggtcctatgtttcgcacttatcaggagctgttccggcgaatcttcatcgctaccgacgcggccatcgtcgtcgtgagttttctactcgcatggtggctcaagtttgattctgggtggattccgcacgccggccatctcccactcctctattatcgagggccgcttctcatcgccgtgatcgtattcgtgcttgcaaacggtgtagcgcggctctacgaaccgatgcgcgcgaagagcttgttctacgaggcgtacagcgtagcgaagggcgtcatcctcgggacaattgtcctcatggctgccctctatttcgcgaagatgcaggagttttcgcgagacgtcatcgcgctctttactggcatcaacttcgggctcatggtgggagagcggatcgtcgtgcgctccgtgctgcgcagcctgcgccgccgagggttgaatcagcgatttctcctcatcgtgggctggagtgcagcgacgcgtcgcttcctcgaggccctggaggcccagccgtggttcggttaccgtgtcataggctatctccgttacgaaggtgatgatgcgtcgcgcgcgacagtgccatgcatcggggcggttgacgacattaaatgcgtgcttgaggagcacctcgtcgatcaggtggtcatcgcggcaccgcgggatcgagtgggcgatctcgccgaagtgatttccgcctgcgaagctgtaggggtccagtcgctgatcttgccggattacttcgatctcctgccggccaggccccgttttgaaacctttggagatgtgccgctgattgacacgcgccatgtgccgctggacgatgcggtgaacgccttcctgaagcgcgcgttcgacatcgtgttcagtctgggggtcctgattggtctgtcgccgctgttggtggccattgcgattgcggtgaagctttcgtcgccagggccagtgctgtacgtgcaggagcgagtgggcaaaaatcgacggacatttaagatgtacaagttccgaacgatgtactgggatcccggggcggaccgtgcggagcgggattgcgcggaagaggcggacctgcggagcgctggttggacggtgaaaggcgatccgcggcggactcgcgtgggagcgttcctacgtcgcacgagtttggacgagctccctcagttctggaacgtgctgaagggagacatgagcgtcattgggccgcgcccggagcgccccgtcttcgtcgagcgattccgagaagaggtgccgcgttacatggtcaagcaccgcgtgagaccaggtatcaccgggtgggcgcaggtgcatggatggcgcggagatacttcgattgctgaacggattcgatttgacattgagtacatcgaaaactggtcattctggcttgatctcaagattgtgtggaagactatcaaacatgggtttgtgaatgagaatgcgtattga

SEQ ID NO: 99 - DNA, 1581 bp, Artificial
  Substituion in SEQ ID NO 87
atggacccgaacggtaggtttgcaagttggggaagaacgcccatcgacgtaagggtggtgtcaaaacatgtcgaattaggcttccctcgcttgccaatgatgcgctatactttccttggtagttcacgccgcatcgcgggtggtcctatgtttcgcacttatcaggagctgttccggcgaatcttcatcgctaccgacgcggccatcgtcgtcgtgagttttctactcgcatggtggctcaagtttgattctgggtggattccgcacgccggccatctcccactcctctattatcgagggccgcttctcatcgccgtgatcgtattcgtgcttgcaaacggtgtagcgcggctctacgaaccgatgcgcgcgaagagcttgttctacgaggcgtacagcgtagcgaagggcgtcatcctcgggacaattgtcctcatggctgccctctatttcgcgaagatgcaggagttttcgcgagacgtcatcgcgctctttactggcatcaacttcgggctcatggtgggagagcggatcgtcgtgcgctccgtgctgcgcagcctgcgccgccgagggttgaatcagcgatttctcctcatcgtgggctggagtgcagcgacgcgtcgcttcctcgaggccctggaggcccagccgtggttcggttaccgtgtcataggctatctccgttacgaaggtgatgatgcgtcgcgcgcgacagtgccatgcatcggggcggttgacgacattcgttgcgtgcttgaggagcacctcgtcgatcaggtggtcatcgcggcaccgcgggatcgagtgggcgatctcgccgaagtgatttccgcctgcgaagctgtaggggtccagtcgctgatcttgccggattacttcgatctcctgccggccaggccccgttttgaaacctttggagatgtgccgctgattgacacgcgccatgtgccgctggacgatgcggtgaacgccttcctgaagcgcgcgttcgacatcgtgttcagtctgggggtcctgattggtctgtcgccgctgttggtggccattgcgattgcggtgaagctttcgtcgccagggccagtgctgtacgtgcaggagcgagtgggcaaaaatcgacggacatttaagatgtacaagttccgaacgatgtactgggatcccggggcggaccgtgcggagcgggattgcgcggaagaggcggacctgcggagcgctggttggacggtgaaaggcgatccgcggcggactcgcgtgggagcgttcctacgtcgcacgagtttggacgagctccctcagttctggaacgtgctgaagggagacatgagcgtcattgggccgcgcccggagcgccccgtcttcgtcgagcgattccgagaagaggtgccgcgttacatggtcaagcaccgcgtgagaccaggtatcaccgggtgggcgcaggtgcatggatggcgcggagatacttcgattgctgaacggattcgatttgacattgagtacatcgaaaactggtcattctggcttgatctcaagattgtgtggaagactatcaaacatgggtttgtgaatgagaatgcgtattga

SEQ ID NO: 100 - DNA, 1581 bp, Artificial
  Substituion in SEQ ID NO 87
atggacccgaacggtaggtttgcaagttggggaagaacgcccatcgacgtaagggtggtgtcaaaacatgtcgaaataggcttccctcgcttgccaatgatgcgctatactttccttggtagttcacgccgcatcgcgggtggtcctatgtttcgcacttatcaggagctgttccggcgaatcttcatcgctaccgacgcggccatcgtcgtcgtgagttttctactcgcatggtggctcaagtttgattctgggtggattccgcacgccggccatctcccactcctctattatcgagggccgcttctcatcgccgtgatcgtattcgtgcttgcaaacggtgtagcgcggctctacgaaccgatgcgcgcgaagagcttgttctacgaggcgtacagcgtagcgaagggcgtcatcctcgggacaattgtcctcatggctgccctctatttcgcgaagatgcaggagttttcgcgagacgtcatcgcgctctttactggcatcaacttcgggctcatggtgggagagcggatcgtcgtgcgctccgtgctgcgcagcctgcgccgccgagggttgaatcagcgatttctcctcatcgtgggctggagtgcagcgacgcgtcgcttcctcgaggccctggaggcccagccgtggttcggttaccgtgtcataggctatctccgttacgaaggtgatgatgcgtcgcgcgcgacagtgccatgcatcggggcggttgaagacattcgttgcgtgcttgaggagcacctcgtcgatcaggtggtcatcgcggcaccgcgggatcgagtgggcgatctcgccgaagtgatttccgcctgcgaagctgtaggggtccagtcgctgatcttgccggattacttcgatctcctgccggccaggccccgttttgaaacctttggagatgtgccgctgattgacacgcgccatgtgccgctggacgatgcggtgaacgccttcctgaagcgcgcgttcgacatcgtgttcagtctgggggtcctgattggtctgtcgccgctgttggtggccattgcgattgcggtgaagctttcgtcgccagggccagtgctgtacgtgcaggagcgagtgggcaaaaatcgacggacatttaagatgtacaagttccgaacgatgtactgggatcccggggcggaccgtgcggagcgggattgcgcggaagaggcggacctgcggagcgctggttggacggtgaaaggcgatccgcggcggactcgcgtgggagcgttcctacgtcgcacgagtttggacgagctccctcagttctggaacgtgctgaagggagacatgagcgtcattgggccgcgcccggagcgccccgtcttcgtcgagcgattccgagaagaggtgccgcgttacatggtcaagcaccgcgtgagaccaggtatcaccgggtgggcgcaggtgcatggatggcgcggagatacttcgattgctgaacggattcgatttgacattgagtacatcgaaaactggtcattctggcttgatctcaagattgtgtggaagactatcaaacatgggtttgtgaatgagaatgcgtattga

SEQ ID NO: 101 - DNA, 1581 bp, Artificial
  Substituion in SEQ ID NO 87
atggacccgaacggtaggtttgcaagttggggaagaacgcccatcgacgtaagggtggtgtcaaaacatgtcgaaataggcttccctcgcttgccaatgatgcgctatactttccttggtagttcacgccgcatcgcgggtggtcctatgtttcgcacttatcaggagctgttccggcgaatcttcatcgctaccgacgcggccatcgtcgtcgtgagttttctaattgcatggtggctcaagtttgattctgggtggattccgcacgccggccatctcccactcctctattatcgagggccgcttctcatcgccgtgatcgtattcgtgcttgcaaacggtgtagcgcggctctacgaaccgatgcgcgcgaagagcttgttctacgaggcgtacagcgtagcgaagggcgtcatcctcgggacaattgtcctcatggctgccctctatttcgcgaagatgcaggagttttcgcgagacgtcatcgcgctctttactggcatcaacttcgggctcatggtgggagagcggatcgtcgtgcgctccgtgctgcgcagcctgcgccgccgagggttgaatcagcgatttctcctcatcgtgggctggagtgcagcgacgcgtcgcttcctcgaggccctggaggcccagccgtggttcggttaccgtgtcataggctatctccgttacgaaggtgatgatgcgtcgcgcgcgacagtgccatgcatcggggcggttgacgacattcgttgcgtgcttgaggagcacctcgtcgatcaggtggtcatcgcggcaccgcgggatcgagtgggcgatctcgccgaagtgatttccgcctgcgaagctgtaggggtccagtcgctgatcttgccggattacttcgatctcctgccggccaggccccgttttgaaacctttggagatgtgccgctgattgacacgcgccatgtgccgctggacgatgcggtgaacgccttcctgaagcgcgcgttcgacatcgtgttcagtctgggggtcctgattggtctgtcgccgctgttggtggccattgcgattgcggtgaagctttcgtcgccagggccagtgctgtacgtgcaggagcgagtgggcaaaaatcgacggacatttaagatgtacaagttccgaacgatgtactgggatcccggggcggaccgtgcggagcgggattgcgcggaagaggcggacctgcggagcgctggttggacggtgaaaggcgatccgcggcggactcgcgtgggagcgttcctacgtcgcacgagtttggacgagctccctcagttctggaacgtgctgaagggagacatgagcgtcattgggccgcgcccggagcgccccgtcttcgtcgagcgattccgagaagaggtgccgcgttacatggtcaagcaccgcgtgagaccaggtatcaccgggtgggcgcaggtgcatggatggcgcggagatacttcgattgctgaacggattcgatttgacattgagtacatcgaaaactggtcattctggcttgatctcaagattgtgtggaagactatcaaacatgggtttgtgaatgagaatgcgtattga

SEQ ID NO: 102 - DNA, 1581 bp, Artificial
  Substituion in SEQ ID NO 87
atggacccgaacggtaggtttgcaagttggggaagaacgcccatcgacgtaagggtggtgtcaaaacatgtcgaaataggcttccctcgcttgccaatgatgcgctatactttccttggtagttcacgccgcatcgcgggtggtcctatgtttcgcacttatcaggagctgttccggcgaatcttcatcgctaccgacgcggccatcgtcgtcgtgagttttctactcgcatggtggctcaagtttgattctgggtggattccgcacgccggccatctcccactcctctattatcgagggccgcttctcatcgccgtgatcgtattcgtgcttgcaaacggtgtagcgcggctctacgaaccgatgcgcgcgaagagcttgttctacgaggcgtacagcgtagcgaagggcgtcatcctcgggacaattgtcctcatggctgccctctatttcgcgaagatgcaggagttttcgcgagacgtcatcgcgctctttactggcatcaacttcgggctcatggtgggagagcggatcgtcgtgcgctccgtgctgcgcagcctgcgccgccgagggttgaatcagcgatttctcctcatcgtgggctggagtgcagcgacgcgtcgcttcctcgaggccctggaggcccagccgtggttcggttaccgtgtcataggctatctccgttacgaaggtgatgatgcgtcgcgcgcgacagtgccatgcatcggggcggttgacgacattcgttgcgtgcttgaggagcacctcgtcgatcaggtggtcatcgcggcaccgcgggatcgagtgggcgatctcgccgaagtgatttccgcctgcgaagctgtaggggtccagtcgctgatcttgccggattacttcgatctcctgccggccaggccccgttttgaaacctttggagatgtgccgctgattgacacgcgccatgtgccgctggacgatgcggtgaacgccttcctgaagcgcgcgttcgacatcgtgttcagtctgggggtcctgattggtctgtcgccgctgttggtggccattgcgattgcggtgaagctttcgtcgccagggccagtgctgtacgtgcaggagcgagtgggcaaaaatcgacggacatttaagatgtacaagttccgaacgatgtactgggatcccggggcggaccgtgcggagcgggattgcgcggaagaggcggacctgaaaagcgctggttggacggtgaaaggcgatccgcggcggactcgcgtgggagcgttcctacgtcgcacgagtttggacgagctccctcagttctggaacgtgctgaagggagacatgagcgtcattgggccgcgcccggagcgccccgtcttcgtcgagcgattccgagaagaggtgccgcgttacatggtcaagcaccgcgtgagaccaggtatcaccgggtgggcgcaggtgcatggatggcgcggagatacttcgattgctgaacggattcgatttgacattgagtacatcgaaaactggtcattctggcttgatctcaagattgtgtggaagactatcaaacatgggtttgtgaatgagaatgcgtattga

SEQ ID NO: 103 - protein, 385 aa, Alicyclobacillus acidocaldarius
MRMRIESTGSRLNRTVRIGVDCRPLVGDKTGIGYYLWEILDEWARAEIDFVELYLYASKPFELPSAFANTRLLYRKRVRRLSPGELWAQTALPVLVARDGIDVFWGPNFCLPLLCHVPTVLTIHDMVYKVLPDTMMRKTYYHNAFGLPLYARKSQKILVPSVNTKLDVVKYLRVAEDRVVVTPLGMPKRFRQELDTGIILSHRFGLEMGSYILAVGTVEPRKNLERVVRAFRLARKAHPDMKLVVAGTLGWASEQTQSALQDEGVIYVGYVSDVELMALYKGCRFFVYVPLYEGFGMPPLEAMAVGKPVLTANNSSLPEVVGRAAILVDATREECIREGMSLLWVDGDLRERLSEQALARARKFSWDETAQKTLNVILNVVGAQT

SEQ ID NO: 104 - DNA, 1158 bp, Alicyclobacillus acidocaldarius
atgagaatgcgtattgagagcactggaagtcgtttgaaccgcacggtgcgaattggcgtggactgcaggccgcttgtcggagataagaccgggattggttattatttgtgggaaattctcgacgaatgggctcgagccgagattgatttcgtcgagctttatctgtacgcatccaagccctttgaactcccgagtgcgtttgcgaacaccagactcctatatcggaagcgtgtgcgtcggctttcgccaggagaattatgggcgcagactgcacttcctgtacttgtggcccgtgatggcattgatgtgttttgggggccgaatttttgtttgcctcttttgtgccatgtaccgactgtacttacgattcacgatatggtgtacaaagtgctacccgatacgatgatgagaaagacgtattatcacaatgcgttcgggctgcctctttacgcgcgaaaatcacagaagatcctagtgccatctgtcaacacaaaattggatgtcgtcaaatatcttcgagtcgccgaagatcgtgtggttgtcacgccgctaggcatgccgaagcgcttccggcaggaattagatacgggaataattctttcgcataggttcggacttgagatgggatcgtacattttggccgtgggtaccgtggaaccaagaaaaaatttggagcgtgttgttcgggcgtttcgattggctcgaaaagctcatccagatatgaagttggttgtggctggtacattggggtgggcttcggagcaaacgcaatcggctttgcaagatgagggagtcatctatgttggctacgtgtctgatgttgagctgatggcattatacaaagggtgtaggttttttgtgtatgtaccgttatacgagggttttggcatgccgccacttgaggccatggcggttggtaagccggtattaacggcaaacaacagttctctcccagaagttgttgggcgggccgcgatcttggtggacgccacgcgtgaggagtgtataagggagggaatgtccttgctttgggttgatggtgacttaagggagcgcttgtctgagcaagcgttggcccgggctcgaaagttctcatgggatgaaactgctcagaaaacgctcaacgtcatcttgaacgtggttggtgcccagacgtga

SEQ ID NO: 105 - protein, 357 aa, Chloroflexus aggregans DSM 9485
RAGVSHYIEQVLLHLAQIDHENRYTIYTTRGLDQAALGLPPNFVVKPSRLPTINPRIRIPWEQGIAPFLLRGKVDLYHGCLNVAPLLSPVPTVITIHDLAFIRFPQTFRAYNRIYLDLATRLSARRASRILAVSEHTKREVAGLFGIPPERIVVTPNATRSHFRPFAADIIDQFRARKGLPARFILYVGTLEPRKNLTTLLEAFALVSRRVPSVPLLIGGGKGWMYQPIFARLEQLNLQDRVKFVGYIPEEELPLWYAAATIFVFPSIYEGFGMPPLEAMACGTPVITSNTSSLPEVVGDAGLMVDPAAPTALADAMMQLLTDADLHAALRQRGLERARRFSWTETAAKTLAVYREV

SEQ ID NO: 106 - protein, 354 aa, Roseiflexus sp. RS-1
RTGTEQYTCEVLAAIARLDTTNTYTLYCQRLPTTLPPLGANMRMRCIPLPRLWTHVRLSVEVLRHAPDVLFIPAHVLPLGAPLVRRMRTVVTIHDLGYLRYPEAHTTAQRLYLRLSTVWSARAASHLIAVSEATRNDLVRLAKVSPARVTVVHHGVADRFRQPVVDLGRARKIAGGNEPYFLYVGTVQPRKNLERVIEAFADASAQLTDQGRTPVLVIAGKRGWLSERIAQRAAALGIADRVRFVGYVADEDLPALYRASLAFVFPSLYEGFGMPVLEAMACGAPVLTSNSSSLPEVAGDAALLVDPHDTGAIAAGMVRLARDEALREELQQHGYRRAAQFTWDRCAEETLRVL

SEQ ID NO: 107 - protein, 360 aa, Rhizobium leguminosarum bv. trifolii WSM1325
MRISIDATGLGGPKTGTSVYLIEILSRWSRNTSINHEFTIFASEKAVSLCSEAGLDHRFRFVRAPNNRHIRVIWQQLMIPWHMRRLGIDVHWGTAFVLPVASQRPMAVTIHDLTFQLFPEVHERLKRFYFPAIMQRSVAKAQAVFAVSRTTETDLKRIIPESRGKTTVTLLAARKLGSDSQAPRDQRNSGDYLLFVGTLEPRKNLPRLLAAWQMLDDATRGNTRLVIVGATGWMVSDLLQSLKTNDTIDFLGHVSDSSLAELMQGARALLYPSLYEGFGLPVVEAMARGIPLLTSNTGATAEIAEGAAILVDPTNVDDIRGGLVRLLTEPELLGALSAQGRERAKSFSWERTAQLTLETL

SEQ ID NO: 108 - protein, 356 aa, Chloroflexus aurantiacus J-10-fl
RVTVAQRTGTERYSYELIAALDRIAPSDIHFRLYVNGRRDQLPPVSERATIHDIRLPRLWTHLRLGPTSWRARPHVLFVPAHVVPLLHPPTVVTIHDVGYRAFPETHTARRRLELELTTRWSLRAARHVITISHATKRDLINWYGADPNRITVTHLGCSSIFAPPADPRVVAAVTAHYGLDQRPYLLYIGTVQPRKNLSRVIDALALTIAAGYDLDLVIAGKRGWLSEPIERRAGELGIANRVHFTGFVADADLPALLAGALAFVFPSLYEGFGMPVVEAMACGTPVITSTSSSLPEIAGDAALLVDPLDTNAIAAAIMRLSDDQDLRATLRQRGLARAHLFNWETCARQTLAVLL

SEQ ID NO: 109 - protein, 368 aa, Roseiflexus castenholzii DSM 13941
MRIGIDISRMATIARTGTEHYTGEVVAAIARRDAVNTYTLYCNQPPARLPSLGANMTVRCIPLPRLWTHVRLSGEVLRHPPDVLFIPAHVLPLGAPLVRRMRTVVTVHDLGYVRYPEAHTAAQRLYLQMSTIWSARAASHLIAVSAATRNDLVRLAGVSPNRITVVHHGVAERFRRALADSSRTRAITGGDEPYFLYVGTVQPRKNLARVIAAFADASRRLTGCGMAPILVIAGKRGWLSEGIARRAAEVGIADRVRFVGYVADDDLPALYHGALAFVFPSLYEGFGMPVLEAMACGAPVLTSNSSSLPEVAGDAALIVDPLDTGAIAEGMVRLVCDAALRQELRQRGYRRAAQFTWDRCAEETLRVL

SEQ ID NO: 110 - protein, 385 aa, Artificial
  Substituion in SEQ ID NO 103
MRMRIESTGSRLNRTVRIGVDCRPLVGDKTGLGYYLWEILDEWARAEIDFVELYLYASKPFELPSAFANTRLLYRKRVRRLSPGELWAQTALPVLVARDGIDVFWGPNFCLPLLCHVPTVLTIHDMVYKVLPDTMMRKTYYHNAFGLPLYARKSQKILVPSVNTKLDVVKYLRVAEDRVVVTPLGMPKRFRQELDTGIILSHRFGLEMGSYILAVGTVEPRKNLERVVRAFRLARKAHPDMKLVVAGTLGWASEQTQSALQDEGVIYVGYVSDVELMALYKGCRFFVYVPLYEGFGMPPLEAMAVGKPVLTANNSSLPEVVGRAAILVDATREECIREGMSLLWVDGDLRERLSEQALARARKFSWDETAQKTLNVILNVVGAQT

SEQ ID NO: 111 - protein, 385 aa, Artificial
  Substituion in SEQ ID NO 103
MRMRIESTGSRLNRTVRIGVDCRPLVGDKTGIGYYLWEILDEWARAEIDFVELYLYASKPFELPSAFANTRLLYRKRVRRLSPGELWAQTALPVLVARDGIDVFWGPNFCLPLLCHVPTVLTIHDMVYKVLPDTMMRKTYYHNAFGLPLYARKSQKILVPSVNTKLDVVKYLRVAEDRVVVTPLGMPKRFRQELDTGIILSHRFGLEMGSYILAVGTVEPRKNLERVVRAFRLARKAHPDMKLVVAGTLGWASEQTQSALQDEGVIYVGYVSDVELMALYKGCRFFVYVPLYEGFGMPPLEAMAVGKPVLTANNSSLPEVVGRAAILVDATREECIREGMSILWVDGDLRERLSEQALARARKFSWDETAQKTLNVILNVVGAQT

SEQ ID NO: 112 - protein, 385 aa, Artificial
  Substituion in SEQ ID NO 103
MRMRIESTGSRLNRTVRIGVDCRPLVGDKTGIGYYLWEILDEWARAEIDFVELYLYASKPFELPSAFANTRLLYRKRVRRLSPGELWAQTALPVLVARDGIDVFWGPNFCLPLLCHVPTVLTIHDMVYKVLPDTMMRKTYYHNAFGLPLYARKSQRILVPSVNTKLDVVKYLRVAEDRVVVTPLGMPKRFRQELDTGIILSHRFGLEMGSYILAVGTVEPRKNLERVVRAFRLARKAHPDMKLVVAGTLGWASEQTQSALQDEGVIYVGYVSDVELMALYKGCRFFVYVPLYEGFGMPPLEAMAVGKPVLTANNSSLPEVVGRAAILVDATREECIREGMSLLWVDGDLRERLSEQALARARKFSWDETAQKTLNVILNVVGAQT

SEQ ID NO: 113 - protein, 385 aa, Artificial
  Substituion in SEQ ID NO 103
MRMRIESTGSRLNRTVRIGVDCRPLVGDKTGIGYYLWEILDEWARAEIDFVELYLYASKPFELPSAFANTRLLYRKRVRRLSPGELWAQTALPVLVARDGLDVFWGPNFCLPLLCHVPTVLTIHDMVYKVLPDTMMRKTYYHNAFGLPLYARKSQKILVPSVNTKLDVVKYLRVAEDRVVVTPLGMPKRFRQELDTGIILSHRFGLEMGSYILAVGTVEPRKNLERVVRAFRLARKAHPDMKLVVAGTLGWASEQTQSALQDEGVIYVGYVSDVELMALYKGCRFFVYVPLYEGFGMPPLEAMAVGKPVLTANNSSLPEVVGRAAILVDATREECIREGMSLLWVDGDLRERLSEQALARARKFSWDETAQKTLNVILNVVGAQT

SEQ ID NO: 114 - protein, 385 aa, Artificial
  Substituion in SEQ ID NO 103
MRMRIESTGSRLNRTVRIGVDCRPLVGDKTGIGYYLWEILDEWARAEIDFVELYLYASKPFELPSAFANTRLLYRKRVRRLSPGELWAQTALPVLVARDGIDVFWGPNFCLPLLCHVPTVLTIHDMVYKVLPDTMMRKTYYHNAFGLPLYARKSQKILVPSVNTKLDVVKYLRVAEDRVVVTPLGMPKRFRQELDTGIILSHRFGLEMGSYILAVGTVEPRKNLERVVRAFRLARKAHPDMKLVVAGTLGWASEQTQSALQDEGVIYVGYVSDVELMALYKGCRFFVYVPLYEGFGMPPLEAMAVGKPVLTANNSSLPEVVGRAAILVDATREECIREGMSLLWVDGDLRDRLSEQALARARKFSWDETAQKTLNVILNVVGAQT

SEQ ID NO: 115 - DNA, 1158 bp, Artificial
  Substituion in SEQ ID NO 104
atgagaatgcgtattgagagcactggaagtcgtttgaaccgcacggtgcgaattggcgtggactgcaggccgcttgtcggagataagaccgggttaggttattatttgtgggaaattctcgacgaatgggctcgagccgagattgatttcgtcgagctttatctgtacgcatccaagccctttgaactcccgagtgcgtttgcgaacaccagactcctatatcggaagcgtgtgcgtcggctttcgccaggagaattatgggcgcagactgcacttcctgtacttgtggcccgtgatggcattgatgtgttttgggggccgaatttttgtttgcctcttttgtgccatgtaccgactgtacttacgattcacgatatggtgtacaaagtgctacccgatacgatgatgagaaagacgtattatcacaatgcgttcgggctgcctctttacgcgcgaaaatcacagaagatcctagtgccatctgtcaacacaaaattggatgtcgtcaaatatcttcgagtcgccgaagatcgtgtggttgtcacgccgctaggcatgccgaagcgcttccggcaggaattagatacgggaataattctttcgcataggttcggacttgagatgggatcgtacattttggccgtgggtaccgtggaaccaagaaaaaatttggagcgtgttgttcgggcgtttcgattggctcgaaaagctcatccagatatgaagttggttgtggctggtacattggggtgggcttcggagcaaacgcaatcggctttgcaagatgagggagtcatctatgttggctacgtgtctgatgttgagctgatggcattatacaaagggtgtaggttttttgtgtatgtaccgttatacgagggttttggcatgccgccacttgaggccatggcggttggtaagccggtattaacggcaaacaacagttctctcccagaagttgttgggcgggccgcgatcttggtggacgccacgcgtgaggagtgtataagggagggaatgtccttgctttgggttgatggtgacttaagggagcgcttgtctgagcaagcgttggcccgggctcgaaagttctcatgggatgaaactgctcagaaaacgctcaacgtcatcttgaacgtggttggtgcccagacgtga

SEQ ID NO: 116 - DNA, 1158 bp, Artificial
  Substituion in SEQ ID NO 104
atgagaatgcgtattgagagcactggaagtcgtttgaaccgcacggtgcgaattggcgtggactgcaggccgcttgtcggagataagaccgggattggttattatttgtgggaaattctcgacgaatgggctcgagccgagattgatttcgtcgagctttatctgtacgcatccaagccctttgaactcccgagtgcgtttgcgaacaccagactcctatatcggaagcgtgtgcgtcggctttcgccaggagaattatgggcgcagactgcacttcctgtacttgtggcccgtgatggcattgatgtgttttgggggccgaatttttgtttgcctcttttgtgccatgtaccgactgtacttacgattcacgatatggtgtacaaagtgctacccgatacgatgatgagaaagacgtattatcacaatgcgttcgggctgcctctttacgcgcgaaaatcacagaagatcctagtgccatctgtcaacacaaaattggatgtcgtcaaatatcttcgagtcgccgaagatcgtgtggttgtcacgccgctaggcatgccgaagcgcttccggcaggaattagatacgggaataattctttcgcataggttcggacttgagatgggatcgtacattttggccgtgggtaccgtggaaccaagaaaaaatttggagcgtgttgttcgggcgtttcgattggctcgaaaagctcatccagatatgaagttggttgtggctggtacattggggtgggcttcggagcaaacgcaatcggctttgcaagatgagggagtcatctatgttggctacgtgtctgatgttgagctgatggcattatacaaagggtgtaggttttttgtgtatgtaccgttatacgagggttttggcatgccgccacttgaggccatggcggttggtaagccggtattaacggcaaacaacagttctctcccagaagttgttgggcgggccgcgatcttggtggacgccacgcgtgaggagtgtataagggagggaatgtccattctttgggttgatggtgacttaagggagcgcttgtctgagcaagcgttggcccgggctcgaaagttctcatgggatgaaactgctcagaaaacgctcaacgtcatcttgaacgtggttggtgcccagacgtga

SEQ ID NO: 117 - DNA, 1158 bp, Artificial
  Substituion in SEQ ID NO 104
atgagaatgcgtattgagagcactggaagtcgtttgaaccgcacggtgcgaattggcgtggactgcaggccgcttgtcggagataagaccgggattggttattatttgtgggaaattctcgacgaatgggctcgagccgagattgatttcgtcgagctttatctgtacgcatccaagccctttgaactcccgagtgcgtttgcgaacaccagactcctatatcggaagcgtgtgcgtcggctttcgccaggagaattatgggcgcagactgcacttcctgtacttgtggcccgtgatggcattgatgtgttttgggggccgaatttttgtttgcctcttttgtgccatgtaccgactgtacttacgattcacgatatggtgtacaaagtgctacccgatacgatgatgagaaagacgtattatcacaatgcgttcgggctgcctctttacgcgcgaaaatcacagcgtatcctagtgccatctgtcaacacaaaattggatgtcgtcaaatatcttcgagtcgccgaagatcgtgtggttgtcacgccgctaggcatgccgaagcgcttccggcaggaattagatacgggaataattctttcgcataggttcggacttgagatgggatcgtacattttggccgtgggtaccgtggaaccaagaaaaaatttggagcgtgttgttcgggcgtttcgattggctcgaaaagctcatccagatatgaagttggttgtggctggtacattggggtgggcttcggagcaaacgcaatcggctttgcaagatgagggagtcatctatgttggctacgtgtctgatgttgagctgatggcattatacaaagggtgtaggttttttgtgtatgtaccgttatacgagggttttggcatgccgccacttgaggccatggcggttggtaagccggtattaacggcaaacaacagttctctcccagaagttgttgggcgggccgcgatcttggtggacgccacgcgtgaggagtgtataagggagggaatgtccttgctttgggttgatggtgacttaagggagcgcttgtctgagcaagcgttggcccgggctcgaaagttctcatgggatgaaactgctcagaaaacgctcaacgtcatcttgaacgtggttggtgcccagacgtga

SEQ ID NO: 118 - DNA, 1158 bp, Artificial
  Substituion in SEQ ID NO 104
atgagaatgcgtattgagagcactggaagtcgtttgaaccgcacggtgcgaattggcgtggactgcaggccgcttgtcggagataagaccgggattggttattatttgtgggaaattctcgacgaatgggctcgagccgagattgatttcgtcgagctttatctgtacgcatccaagccctttgaactcccgagtgcgtttgcgaacaccagactcctatatcggaagcgtgtgcgtcggctttcgccaggagaattatgggcgcagactgcacttcctgtacttgtggcccgtgatggcttagatgtgttttgggggccgaatttttgtttgcctcttttgtgccatgtaccgactgtacttacgattcacgatatggtgtacaaagtgctacccgatacgatgatgagaaagacgtattatcacaatgcgttcgggctgcctctttacgcgcgaaaatcacagaagatcctagtgccatctgtcaacacaaaattggatgtcgtcaaatatcttcgagtcgccgaagatcgtgtggttgtcacgccgctaggcatgccgaagcgcttccggcaggaattagatacgggaataattctttcgcataggttcggacttgagatgggatcgtacattttggccgtgggtaccgtggaaccaagaaaaaatttggagcgtgttgttcgggcgtttcgattggctcgaaaagctcatccagatatgaagttggttgtggctggtacattggggtgggcttcggagcaaacgcaatcggctttgcaagatgagggagtcatctatgttggctacgtgtctgatgttgagctgatggcattatacaaagggtgtaggttttttgtgtatgtaccgttatacgagggttttggcatgccgccacttgaggccatggcggttggtaagccggtattaacggcaaacaacagttctctcccagaagttgttgggcgggccgcgatcttggtggacgccacgcgtgaggagtgtataagggagggaatgtccttgctttgggttgatggtgacttaagggagcgcttgtctgagcaagcgttggcccgggctcgaaagttctcatgggatgaaactgctcagaaaacgctcaacgtcatcttgaacgtggttggtgcccagacgtga

SEQ ID NO: 119 - DNA, 1158 bp, Artificial
  Substituion in SEQ ID NO 104
atgagaatgcgtattgagagcactggaagtcgtttgaaccgcacggtgcgaattggcgtggactgcaggccgcttgtcggagataagaccgggattggttattatttgtgggaaattctcgacgaatgggctcgagccgagattgatttcgtcgagctttatctgtacgcatccaagccctttgaactcccgagtgcgtttgcgaacaccagactcctatatcggaagcgtgtgcgtcggctttcgccaggagaattatgggcgcagactgcacttcctgtacttgtggcccgtgatggcattgatgtgttttgggggccgaatttttgtttgcctcttttgtgccatgtaccgactgtacttacgattcacgatatggtgtacaaagtgctacccgatacgatgatgagaaagacgtattatcacaatgcgttcgggctgcctctttacgcgcgaaaatcacagaagatcctagtgccatctgtcaacacaaaattggatgtcgtcaaatatcttcgagtcgccgaagatcgtgtggttgtcacgccgctaggcatgccgaagcgcttccggcaggaattagatacgggaataattctttcgcataggttcggacttgagatgggatcgtacattttggccgtgggtaccgtggaaccaagaaaaaatttggagcgtgttgttcgggcgtttcgattggctcgaaaagctcatccagatatgaagttggttgtggctggtacattggggtgggcttcggagcaaacgcaatcggctttgcaagatgagggagtcatctatgttggctacgtgtctgatgttgagctgatggcattatacaaagggtgtaggttttttgtgtatgtaccgttatacgagggttttggcatgccgccacttgaggccatggcggttggtaagccggtattaacggcaaacaacagttctctcccagaagttgttgggcgggccgcgatcttggtggacgccacgcgtgaggagtgtataagggagggaatgtccttgctttgggttgatggtgacttaagggatcgcttgtctgagcaagcgttggcccgggctcgaaagttctcatgggatgaaactgctcagaaaacgctcaacgtcatcttgaacgtggttggtgcccagacgtga

SEQ ID NO: 120 - protein, 506 aa, Alicyclobacillus acidocaldarius
MVSLTISLLADIYEGRHGFAGISTDMRTTYAGLASTADISLTGLIYAQRPLGNESVVRHLLMMSRPDLMRLAHEIAGHRVPDNVFATMEHMLSGKRGMMLGDLSRVVRWALLTTRTYRTHPIDSDVYYDLIWRFFFEKTLAPKELENVRQTQFVISGLSHAIGNATLKRWGRPLRLDARKWDVVLTFNVSPIEFVGRRITRVHDLIPLVRPDFVPIEHAEIFKAQLELTLRNSQAIVTVSKCAAGDLVRLYPNTQSKIEIIPCATSRRYYRDLSSIPLQRIVERRLSEFHRHCRKRDRRLPQITPFKYFIYHGTIEPKKNVKTLLLAFDSLVNQERFREYKLIIAGRFGWMYDQERTHMAKLIEKGAVIHLEDTTNDELRVLLSNALAHVFPSYYEGFGIPPVEALSCGCPTIVSNVSSLPEVVGRAGILVSPYDAEWLASEMGAVALAPESVRERIERESKYVLEQYAESTVRDKWMRVIEKSLSLGGRTASTLMAENYRVDSVL

SEQ ID NO: 121 - DNA, 1521 bp, Alicyclobacillus acidocaldarius
gtggtttcgttgacgatttcgttgctcgcggatatctatgaaggacgacatgggttcgccggtatttcgacagacatgagaacgacgtatgctggcctggcgtcgactgccgacatatcgctcacgggactcatttatgctcagcgtcccttgggcaacgaatcggtcgtgcggcatcttctgatgatgtctcgccccgatttgatgcgactcgctcacgaaatcgcagggcatcgagttcccgataacgtcttcgcaacgatggagcacatgttgtctggaaaacgaggtatgatgctgggcgacctgtcgcgtgtcgttaggtgggcacttttaacaacgaggacttaccgtacccatccgatcgacagtgacgtttattatgacttgatatggcggttcttttttgagaagacactggcgccaaaggaactcgagaatgtacgccagacgcagtttgtgatatctggcttgtctcacgcaattggcaacgcaacgctgaaaagatggggccgacctcttcgattggatgctagaaaatgggatgtggttcttacctttaacgtgtcacccatcgaatttgtcggaagacggatcactcgcgtgcatgacctcataccattggttcgtccggattttgtgcctattgagcatgctgagatcttcaaggcacaactcgagttgacgctgaggaattcgcaggccattgtcacggtgtcaaagtgtgctgccggcgatctggtgcgtttatatccaaatacgcagtccaaaattgaaatcatcccatgcgcgacgtctcgacgatattatcgtgatttatcatcgattcctctgcagcgtattgtcgagcgaaggttgtcggagtttcacaggcattgtcgcaagcgcgatcgccgattaccgcagattacgccgttcaaatattttatatatcacgggacgatcgagccgaagaaaaatgtcaaaacgcttctgctagcctttgactctttggtaaatcaagagcggtttagagagtataagctcatcattgcaggaagatttggttggatgtatgaccaagagcgtacgcatatggcgaaattgatcgagaaaggtgccgtcattcatctcgaggatacaacgaacgatgaactcagggttcttttaagcaacgcattggctcatgtgtttccgtcttattacgaaggttttggtataccgcctgttgaggctttgtcgtgtgggtgtcccactattgtttcgaatgtttcttctctaccggaggttgtagggcgagccgggatcctcgtcagtccgtatgatgcagaatggttggcctcggaaatgggggctgtggcgctggctccagaatcagtacgagagcggatcgaacgagaatccaaatatgtgttggaacagtacgccgaatcgactgttcgggacaagtggatgagggtaattgaaaagtcgcttagtttgggtgggcgtacagcctcaacgctgatggcggagaattaccgggtcgactcagtgctgtag

SEQ ID NO: 122 - protein, 265 aa, Methanococcus aeolicus Nankai-3
KIITVYDVIPLQFPETYAKITVFRYKLLFSKTLNTSNKIISISHHTKQDLIKHFKISEDKIKVIHLAANENYKPLKENEINNIKQKYNLNYPFILYVGTLEPRKNIPNLLKALYKLKKHSIKHKLVITGKKGWKYKSIFETIEKLNLQKDVIFTGYVPDEDLPALYNAADLFVYPSLYEGFGLPPLEAMQCGTPVITSNTSSLPEVVGDAGIMVNPYDVDELANKMYEVLTNDGIREELSKKGIERAKLFSWKKCAEEHLKVYEE

SEQ ID NO: 123 - protein, 297 aa, Nitrosococcus oceani ATCC 19707
YEMANQTYLRLGRLTRVKFPRPPALWHATTPLPIRIRGARMVTTVHDLIPLRLPYTTLDNKQFFYRLVRDALRDSDLVLTVSECSKRDILAFYDIPEERVVVTYQSLSLKKASTHQRQSFSVLKSYGLTPGQYVLFVGNIEPKKNLATLIKAMSMLQHDLPLVVVGRKAWLWEEQLQMAKRYFGSNEAKRLRILDYVPSTVLSTLYSHALCMAFPSLYEGFGLPALEAMSHGCPVISSNASSLPEVCGEAALYMDPHDSDGLYAHIESLLEDVCLRARLIEGGYRRVEYFSPERYAE

SEQ ID NO: 124 - protein, 263 aa, Clostridium tetani E88
KKIITVHDLIPYTMPETVGRGYLKKFLRNMPQLIYDADAIITVSKYSKKDILRFFPMDEKKIFVTHLAADEKYRPLNKDKCNYILKNHYNIDNPFILYIGGFSPRKNIKSLLISFSKIYKNLDKDYKLVIVGANKNGTKILMDMAKDLNIESKIIFTGFVPEDHLPILYNSCETFVYPSLYEGFGLPPLEAMCCGTPVITSNVTSIPEVVGDGGILINPNDIDELSNSLEKTLLDVSFKYELKKKALERSSLYSWENTAKNTL

SEQ ID NO: 125 - protein, 270 aa, Chloroflexus aurantiacus J-10-fl
WQRLRLPLRIEWFVGPLDIVHAPDFVLPPTKARTLLTIHDLTFLVEPACAEPNLRRYLSTAVPRSLQRANLIIVDSKATAGDLGRLYGIPRQRVRLLYPAVDERFRPLTGDAVVRVRERLHLPARFLLFVGTLEPRKNLVRLLQAFALLQNEYPDLHLLLAGRKGWLYDDIFAAVEQYHLSERVHFLDFVADEDLPALYNLAEAFVYPSLYEGFGFPVLEALACGTPVVTTKVSSLPEVAGTAAIFVDPLEPEDIADGIRTALSNPASLR

SEQ ID NO: 126 - protein, 271 aa, Bacteroides vulgatus ATCC 8482
FKVKRIVTIHDLTFFIHPSVHTFIKRYYFRLFIKLACRYADRLICVSESTKKDLERICGRRSVSIDVIPLSCSPKMQVGEQELELVKKKFGVVSQYMLFIGTLEPRKNILNLINAFYKFSQKNRDYSLVIIGKKGWFYESIFKLVEELHLERSVVFTGFVTTKEKFILLSGAHSFIYPSIYEGFGLPVLEAITYGIPTITSKLSSLPEVAGNAALYINPYDVQSISDAIESVNCDEETRRKLIKNSEKQRLKYSWKKTANLTYSLYNRCGS

SEQ ID NO: 127 - protein, 506 aa, Artificial
  Substituion in SEQ ID NO 120
MVSLTISLLADIYEGRHGFAGISTDMRTTYAGLASTADISLTGLIYAQRPLGNESVVRHLLMMSRPDLMRLAHEIAGHRVPDNVFATMEHMLSGKRGMMLGDLSRVVRWALLTTRTYRTHPIDSDVYYDLIWRFFFEKTLAPKELENVRQTQFVISGLSHAIGNATLKRWGRPLRLDARKWDVVLTFNVSPIEFVGRRITRVHDLIPLVRPDFVPIEHAEIFKAQLELTLRNSQAIVTVSKCAAGDLVRLYPNTQSKIEIIPCATSRRYYRDLSSIPLQRIVERRLSEFHRHCRKRDRRLPQITPFKYFIYHGTIEPKKNVKTLLLAFDSLVNQERFREYKLIIAGRFGWMYDQERTHMAKLIEKGAVIHLEDTTNDELRVLLSNALAHVFPSYYEGFGIPPVEALSCGCPTIVSNVSSLPEVVGRAGILVSPYDAEWLASEMGAVALAPESVRERIDRESKYVLEQYAESTVRDKWMRVIEKSLSLGGRTASTLMAENYRVDSVL

SEQ ID NO: 128 - protein, 506 aa, Artificial
  Substituion in SEQ ID NO 120
MVSLTISLLADIYEGRHGFAGISTDMRTTYAGLASTADISLTGLIYAQRPLGNESVVRHLLMMSRPDLMRLAHEIAGHRVPDNVFATMEHMLSGKRGMMLGDLSRVVRWALLTTRTYRTHPIDSDVYYDLIWRFFFEKTLAPKELENVRQTQFVISGLSHAIGNATLKRWGRPLRLDARKWDVVLTFNVSPIEFVGRRITRVHDLIPLVRPDFVPIEHAEIFKAQLELTLRNSQAIVTVSKCAAGDLVRLYPNTQSKIEIIPCATSRRYYRDLSSIPLQRIVERRLSEFHRHCRKRDRRLPQITPFKYFIYHGTIEPKKNVKTLLLAFDSLVNQERFREYKLIIAGRFGWMYDQERTHMAKLIEKGAVIHLEDTTNDELRVLISNALAHVFPSYYEGFGIPPVEALSCGCPTIVSNVSSLPEVVGRAGILVSPYDAEWLASEMGAVALAPESVRERIERESKYVLEQYAESTVRDKWMRVIEKSLSLGGRTASTLMAENYRVDSVL

SEQ ID NO: 129 - protein, 506 aa, Artificial
  Substituion in SEQ ID NO 120
MVSLTISLLADIYEGRHGFAGISTDMRTTYAGLASTADISLTGLIYAQRPLGNESVVRHLLMMSRPDLMRLAHEIAGHRVPDNVFATMEHMLSGKRGMMLGDLSRVVRWALLTTRTYRTHPIDSDVYYDLIWRFFFEKTLAPKELDNVRQTQFVISGLSHAIGNATLKRWGRPLRLDARKWDVVLTFNVSPIEFVGRRITRVHDLIPLVRPDFVPIEHAEIFKAQLELTLRNSQAIVTVSKCAAGDLVRLYPNTQSKIEIIPCATSRRYYRDLSSIPLQRIVERRLSEFHRHCRKRDRRLPQITPFKYFIYHGTIEPKKNVKTLLLAFDSLVNQERFREYKLIIAGRFGWMYDQERTHMAKLIEKGAVIHLEDTTNDELRVLLSNALAHVFPSYYEGFGIPPVEALSCGCPTIVSNVSSLPEVVGRAGILVSPYDAEWLASEMGAVALAPESVRERIERESKYVLEQYAESTVRDKWMRVIEKSLSLGGRTASTLMAENYRVDSVL

SEQ ID NO: 130 - protein, 506 aa, Artificial
  Substituion in SEQ ID NO 120
MVSLTISLLADIYEGRHGFAGISTDMRTTYAGLASTADISLTGLIYAQRPLGNESVVRHLLMMSRPDLMRLAHEIAGHRVPDNVFATMEHMLSGKRGMMLGDLSRVVRWALLTTRTYRTHPIDSDVYYDLIWRFFFEKTLAPKELENVRQTQFVISGLSHAIGNATLKRWGRPLRLDARKWDVVLTFNVSPIEFVGRRITRVHDLIPLVRPDFVPIEHAEIFKAQLELTLRNSQAIVTVSKCAAGDLVRLYPNTQSKIEIIPCATSRRYYRDLSSIPLQRIVERRLSEFHRHCRKRDRRLPQITPFKYFIYHGTIEPKKNVKTLLLAFDSLVNQERFREYKLIIAGRFGWMYDQERTHMAKLIEKGAVIHLEDTTNEELRVLLSNALAHVFPSYYEGFGIPPVEALSCGCPTIVSNVSSLPEVVGRAGILVSPYDAEWLASEMGAVALAPESVRERIERESKYVLEQYAESTVRDKWMRVIEKSLSLGGRTASTLMAENYRVDSVL

SEQ ID NO: 131 - protein, 506 aa, Artificial
  Substituion in SEQ ID NO 120
MVSLTISLLADIYEGRHGFAGISTDMRTTYAGLASTADISLTGLIYAQRPLGNESVVRHLLMMSRPDLMRLAHEIAGHRVPDNVFATMEHMLSGKRGMMLGDLSRVVRWALLTTRTYRTHPIDSDVYYDLIWRFFFEKTLAPKELENVRQTQFVISGLSHAIGNATLKRWGRPLRLDARKWDVVLTFNVSPIEFVGRRITRVHDLIPLVRPDFVPIEHAEIFKAQLELTLRNSQAIVTVSKCAAGDLVRLYPNTQSKIEIIPCATSRRYYRDLSSIPLQRIVERRLSEFHRHCRKRDRRLPQITPFKYFIYHGTIEPKKNVKTLLLAFDSLVNQERFREYKLIIAGRFGWMYDQERTHMAKLIEKGAVIHLEDTTNDELRVLLSNALAHVFPSYYEGFGIPPVEALSCGCPTIVSNVSSLPEVVGRAGILVSPYDAEWLASEMGAVALAPESVRERIEKESKYVLEQYAESTVRDKWMRVIEKSLSLGGRTASTLMAENYRVDSVL

SEQ ID NO: 132 - DNA, 1521 bp, Artificial
  Substituion in SEQ ID NO 121
gtggtttcgttgacgatttcgttgctcgcggatatctatgaaggacgacatgggttcgccggtatttcgacagacatgagaacgacgtatgctggcctggcgtcgactgccgacatatcgctcacgggactcatttatgctcagcgtcccttgggcaacgaatcggtcgtgcggcatcttctgatgatgtctcgccccgatttgatgcgactcgctcacgaaatcgcagggcatcgagttcccgataacgtcttcgcaacgatggagcacatgttgtctggaaaacgaggtatgatgctgggcgacctgtcgcgtgtcgttaggtgggcacttttaacaacgaggacttaccgtacccatccgatcgacagtgacgtttattatgacttgatatggcggttcttttttgagaagacactggcgccaaaggaactcgagaatgtacgccagacgcagtttgtgatatctggcttgtctcacgcaattggcaacgcaacgctgaaaagatggggccgacctcttcgattggatgctagaaaatgggatgtggttcttacctttaacgtgtcacccatcgaatttgtcggaagacggatcactcgcgtgcatgacctcataccattggttcgtccggattttgtgcctattgagcatgctgagatcttcaaggcacaactcgagttgacgctgaggaattcgcaggccattgtcacggtgtcaaagtgtgctgccggcgatctggtgcgtttatatccaaatacgcagtccaaaattgaaatcatcccatgcgcgacgtctcgacgatattatcgtgatttatcatcgattcctctgcagcgtattgtcgagcgaaggttgtcggagtttcacaggcattgtcgcaagcgcgatcgccgattaccgcagattacgccgttcaaatattttatatatcacgggacgatcgagccgaagaaaaatgtcaaaacgcttctgctagcctttgactctttggtaaatcaagagcggtttagagagtataagctcatcattgcaggaagatttggttggatgtatgaccaagagcgtacgcatatggcgaaattgatcgagaaaggtgccgtcattcatctcgaggatacaacgaacgatgaactcagggttcttttaagcaacgcattggctcatgtgtttccgtcttattacgaaggttttggtataccgcctgttgaggctttgtcgtgtgggtgtcccactattgtttcgaatgtttcttctctaccggaggttgtagggcgagccgggatcctcgtcagtccgtatgatgcagaatggttggcctcggaaatgggggctgtggcgctggctccagaatcagtacgagagcggatcgatcgagaatccaaatatgtgttggaacagtacgccgaatcgactgttcgggacaagtggatgagggtaattgaaaagtcgcttagtttgggtgggcgtacagcctcaacgctgatggcggagaattaccgggtcgactcagtgctgtag

SEQ ID NO: 133 - DNA, 1521 bp, Artificial
  Substituion in SEQ ID NO 121
gtggtttcgttgacgatttcgttgctcgcggatatctatgaaggacgacatgggttcgccggtatttcgacagacatgagaacgacgtatgctggcctggcgtcgactgccgacatatcgctcacgggactcatttatgctcagcgtcccttgggcaacgaatcggtcgtgcggcatcttctgatgatgtctcgccccgatttgatgcgactcgctcacgaaatcgcagggcatcgagttcccgataacgtcttcgcaacgatggagcacatgttgtctggaaaacgaggtatgatgctgggcgacctgtcgcgtgtcgttaggtgggcacttttaacaacgaggacttaccgtacccatccgatcgacagtgacgtttattatgacttgatatggcggttcttttttgagaagacactggcgccaaaggaactcgagaatgtacgccagacgcagtttgtgatatctggcttgtctcacgcaattggcaacgcaacgctgaaaagatggggccgacctcttcgattggatgctagaaaatgggatgtggttcttacctttaacgtgtcacccatcgaatttgtcggaagacggatcactcgcgtgcatgacctcataccattggttcgtccggattttgtgcctattgagcatgctgagatcttcaaggcacaactcgagttgacgctgaggaattcgcaggccattgtcacggtgtcaaagtgtgctgccggcgatctggtgcgtttatatccaaatacgcagtccaaaattgaaatcatcccatgcgcgacgtctcgacgatattatcgtgatttatcatcgattcctctgcagcgtattgtcgagcgaaggttgtcggagtttcacaggcattgtcgcaagcgcgatcgccgattaccgcagattacgccgttcaaatattttatatatcacgggacgatcgagccgaagaaaaatgtcaaaacgcttctgctagcctttgactctttggtaaatcaagagcggtttagagagtataagctcatcattgcaggaagatttggttggatgtatgaccaagagcgtacgcatatggcgaaattgatcgagaaaggtgccgtcattcatctcgaggatacaacgaacgatgaactcagggttcttattagcaacgcattggctcatgtgtttccgtcttattacgaaggttttggtataccgcctgttgaggctttgtcgtgtgggtgtcccactattgtttcgaatgtttcttctctaccggaggttgtagggcgagccgggatcctcgtcagtccgtatgatgcagaatggttggcctcggaaatgggggctgtggcgctggctccagaatcagtacgagagcggatcgaacgagaatccaaatatgtgttggaacagtacgccgaatcgactgttcgggacaagtggatgagggtaattgaaaagtcgcttagtttgggtgggcgtacagcctcaacgctgatggcggagaattaccgggtcgactcagtgctgtag

SEQ ID NO: 134 - DNA, 1521 bp, Artificial
  Substituion in SEQ ID NO 121
gtggtttcgttgacgatttcgttgctcgcggatatctatgaaggacgacatgggttcgccggtatttcgacagacatgagaacgacgtatgctggcctggcgtcgactgccgacatatcgctcacgggactcatttatgctcagcgtcccttgggcaacgaatcggtcgtgcggcatcttctgatgatgtctcgccccgatttgatgcgactcgctcacgaaatcgcagggcatcgagttcccgataacgtcttcgcaacgatggagcacatgttgtctggaaaacgaggtatgatgctgggcgacctgtcgcgtgtcgttaggtgggcacttttaacaacgaggacttaccgtacccatccgatcgacagtgacgtttattatgacttgatatggcggttcttttttgagaagacactggcgccaaaggaactcgataatgtacgccagacgcagtttgtgatatctggcttgtctcacgcaattggcaacgcaacgctgaaaagatggggccgacctcttcgattggatgctagaaaatgggatgtggttcttacctttaacgtgtcacccatcgaatttgtcggaagacggatcactcgcgtgcatgacctcataccattggttcgtccggattttgtgcctattgagcatgctgagatcttcaaggcacaactcgagttgacgctgaggaattcgcaggccattgtcacggtgtcaaagtgtgctgccggcgatctggtgcgtttatatccaaatacgcagtccaaaattgaaatcatcccatgcgcgacgtctcgacgatattatcgtgatttatcatcgattcctctgcagcgtattgtcgagcgaaggttgtcggagtttcacaggcattgtcgcaagcgcgatcgccgattaccgcagattacgccgttcaaatattttatatatcacgggacgatcgagccgaagaaaaatgtcaaaacgcttctgctagcctttgactctttggtaaatcaagagcggtttagagagtataagctcatcattgcaggaagatttggttggatgtatgaccaagagcgtacgcatatggcgaaattgatcgagaaaggtgccgtcattcatctcgaggatacaacgaacgatgaactcagggttcttttaagcaacgcattggctcatgtgtttccgtcttattacgaaggttttggtataccgcctgttgaggctttgtcgtgtgggtgtcccactattgtttcgaatgtttcttctctaccggaggttgtagggcgagccgggatcctcgtcagtccgtatgatgcagaatggttggcctcggaaatgggggctgtggcgctggctccagaatcagtacgagagcggatcgaacgagaatccaaatatgtgttggaacagtacgccgaatcgactgttcgggacaagtggatgagggtaattgaaaagtcgcttagtttgggtgggcgtacagcctcaacgctgatggcggagaattaccgggtcgactcagtgctgtag

SEQ ID NO: 135 - DNA, 1521 bp, Artificial
  Substituion in SEQ ID NO 121
gtggtttcgttgacgatttcgttgctcgcggatatctatgaaggacgacatgggttcgccggtatttcgacagacatgagaacgacgtatgctggcctggcgtcgactgccgacatatcgctcacgggactcatttatgctcagcgtcccttgggcaacgaatcggtcgtgcggcatcttctgatgatgtctcgccccgatttgatgcgactcgctcacgaaatcgcagggcatcgagttcccgataacgtcttcgcaacgatggagcacatgttgtctggaaaacgaggtatgatgctgggcgacctgtcgcgtgtcgttaggtgggcacttttaacaacgaggacttaccgtacccatccgatcgacagtgacgtttattatgacttgatatggcggttcttttttgagaagacactggcgccaaaggaactcgagaatgtacgccagacgcagtttgtgatatctggcttgtctcacgcaattggcaacgcaacgctgaaaagatggggccgacctcttcgattggatgctagaaaatgggatgtggttcttacctttaacgtgtcacccatcgaatttgtcggaagacggatcactcgcgtgcatgacctcataccattggttcgtccggattttgtgcctattgagcatgctgagatcttcaaggcacaactcgagttgacgctgaggaattcgcaggccattgtcacggtgtcaaagtgtgctgccggcgatctggtgcgtttatatccaaatacgcagtccaaaattgaaatcatcccatgcgcgacgtctcgacgatattatcgtgatttatcatcgattcctctgcagcgtattgtcgagcgaaggttgtcggagtttcacaggcattgtcgcaagcgcgatcgccgattaccgcagattacgccgttcaaatattttatatatcacgggacgatcgagccgaagaaaaatgtcaaaacgcttctgctagcctttgactctttggtaaatcaagagcggtttagagagtataagctcatcattgcaggaagatttggttggatgtatgaccaagagcgtacgcatatggcgaaattgatcgagaaaggtgccgtcattcatctcgaggatacaacgaacgaagaactcagggttcttttaagcaacgcattggctcatgtgtttccgtcttattacgaaggttttggtataccgcctgttgaggctttgtcgtgtgggtgtcccactattgtttcgaatgtttcttctctaccggaggttgtagggcgagccgggatcctcgtcagtccgtatgatgcagaatggttggcctcggaaatgggggctgtggcgctggctccagaatcagtacgagagcggatcgaacgagaatccaaatatgtgttggaacagtacgccgaatcgactgttcgggacaagtggatgagggtaattgaaaagtcgcttagtttgggtgggcgtacagcctcaacgctgatggcggagaattaccgggtcgactcagtgctgtag

SEQ ID NO: 136 - DNA, 1521 bp, Artificial
  Substituion in SEQ ID NO 121
gtggtttcgttgacgatttcgttgctcgcggatatctatgaaggacgacatgggttcgccggtatttcgacagacatgagaacgacgtatgctggcctggcgtcgactgccgacatatcgctcacgggactcatttatgctcagcgtcccttgggcaacgaatcggtcgtgcggcatcttctgatgatgtctcgccccgatttgatgcgactcgctcacgaaatcgcagggcatcgagttcccgataacgtcttcgcaacgatggagcacatgttgtctggaaaacgaggtatgatgctgggcgacctgtcgcgtgtcgttaggtgggcacttttaacaacgaggacttaccgtacccatccgatcgacagtgacgtttattatgacttgatatggcggttcttttttgagaagacactggcgccaaaggaactcgagaatgtacgccagacgcagtttgtgatatctggcttgtctcacgcaattggcaacgcaacgctgaaaagatggggccgacctcttcgattggatgctagaaaatgggatgtggttcttacctttaacgtgtcacccatcgaatttgtcggaagacggatcactcgcgtgcatgacctcataccattggttcgtccggattttgtgcctattgagcatgctgagatcttcaaggcacaactcgagttgacgctgaggaattcgcaggccattgtcacggtgtcaaagtgtgctgccggcgatctggtgcgtttatatccaaatacgcagtccaaaattgaaatcatcccatgcgcgacgtctcgacgatattatcgtgatttatcatcgattcctctgcagcgtattgtcgagcgaaggttgtcggagtttcacaggcattgtcgcaagcgcgatcgccgattaccgcagattacgccgttcaaatattttatatatcacgggacgatcgagccgaagaaaaatgtcaaaacgcttctgctagcctttgactctttggtaaatcaagagcggtttagagagtataagctcatcattgcaggaagatttggttggatgtatgaccaagagcgtacgcatatggcgaaattgatcgagaaaggtgccgtcattcatctcgaggatacaacgaacgatgaactcagggttcttttaagcaacgcattggctcatgtgtttccgtcttattacgaaggttttggtataccgcctgttgaggctttgtcgtgtgggtgtcccactattgtttcgaatgtttcttctctaccggaggttgtagggcgagccgggatcctcgtcagtccgtatgatgcagaatggttggcctcggaaatgggggctgtggcgctggctccagaatcagtacgagagcggatcgaaaaagaatccaaatatgtgttggaacagtacgccgaatcgactgttcgggacaagtggatgagggtaattgaaaagtcgcttagtttgggtgggcgtacagcctcaacgctgatggcggagaattaccgggtcgactcagtgctgtag

SEQ ID NO: 137 - protein, 397 aa, Alicyclobacillus acidocaldarius
MFSNFVWSWLAHALPRAAWLPVLCAVVWTAIFLRTIPDLVRTPRLRPREAARASPPSYGRVSVVVAARDEREHIEVTLESLLRQTYPDLEIVAVDDRSTDGTGDVIDRMAASDSRIVPVHIRELPRGWLGKNHALYAGAMRATGDWLLFADADVRFYPDAVERAMAYVHAHRLHHLTVAPRLIASGYALKLLTAMYIFNYVLFKRPQSAYRRRTRAHAGIGAFNLVSREAYERIGTHRAISLRPDDDLHLGKLIKRHGFRQRFVVAQDMIEIEWYPSFRAMVVGMEKAPLPAFHYSAVLLTAAMMVMMVLYTTPFAGAIFGPGWYRLVYLYCLVLMGILYELHAVFLRLPKHQFLILPLGMLLYSYAFIRSAVLAVRRGGLVWRDTFYTLRELRRGL

SEQ ID NO: 138 - DNA, 1194 bp, Alicyclobacillus acidocaldarius
atgttctccaacttcgtgtggtcctggcttgcgcacgcgcttccgcgggcggcgtggctgcccgtcctgtgcgcggtggtgtggacggccatctttctccgcaccatcccggacctcgtgcgaacgccgcgccttcggccccgtgaggcggcgagagcgagcccaccgtcctatggccgcgtgagcgtcgtggtggcggcgcgcgatgagcgggagcacatcgaggtcacgctcgaatcgctgctgcgccagacgtatccggatctcgaaatcgtcgcggttgacgatcggtcgacggacgggacgggcgacgtgatcgaccggatggcggccagcgattcgcgcattgtgccggtgcacatccgagagctgccgcgtggatggctgggcaagaaccacgccctgtatgcaggcgctatgcgcgcgacgggcgattggctgctgtttgcggacgcggacgtgcggttttacccggacgcggtggaacgggccatggcctacgtgcacgcgcatcggctgcatcacctgaccgtggcgccgaggctcatcgcatccggctacgcgctgaagctattgacggccatgtacatcttcaactatgtgctgttcaagcggccccagagcgcgtaccgcaggcgcactcgcgcacacgccggcatcggcgcgttcaacctcgtcagccgcgaggcgtacgagcgcatcggcacgcatcgagccatcagcttacgtcccgacgacgatctccacctcggcaagctcatcaagcggcatggatttcggcagcgattcgtcgtggcgcaggacatgatcgagatcgagtggtatccgagcttccgcgcgatggtcgtcggcatggagaaagcgccgctgccggcatttcactattccgcggtgcttttgacggcggccatgatggtgatgatggtgctctacacgacgcctttcgcaggggccatcttcggaccgggttggtatcgattggtttatctgtattgtctcgtcctcatgggaatcttatatgaacttcatgcggtgtttttgagactgcccaagcaccagttcctcatcctgccgctcggcatgctgctgtacagctacgccttcattcgttcggccgtgctggcggttcgccgaggagggctcgtgtggcgggacacgttttacacgctgcgcgaactgcgccgaggtctgtga

SEQ ID NO: 139 - protein, 377 aa, Bacillus selenitireducens MLS10
AWITVILWGLVLIDTWIGFRRFPKLDSFRETVLSPADRSGRVSVIVAARNEEDAIYESVKSQLTSTWPGVEWILVNDRSTDATGEKMDELARQDSRIRVVHVRDLPEGWLGKNHAMHCGYEEATGSALLFTDADVMFRPHTIEGAMACKKTTGARHVTMTPEMTVKTFWTQAFVHFFLFGFSYYKRPWKANDDRSKIALGIGAFNLIDREAYEAIGTHRAIRLRPDDDLMLGVRVKAAGMRQRAIDGTGGLSVEWYPSLKEAVKGLEKNTFAGLHYSWLMVLFALSGVFVSQVLPFIGVLFHEGSARWVYLAAVVLMLIIYVKTSFAPWKKALKTFTVFPLSALIFIYTLIRAVLKTVIRGGIEWRGTFYSLKELKK

SEQ ID NO: 140 - protein, 375 aa, Bacillus sp. NRRL B-14911
AILLALCMIIWICAIADAFLGLRRLDQLEEEEELASGPLLSIVTAARNEAAVIEESIRTQLSQNYTHLEWILVNDRSEDGTGEIMERLAQEDARIRVLHIHDLPDGWLGKNHALCRGAGMAKGDIILFTDADVMFRKDAIGRALSYFRRQGLDHLTAAPALKAHSFWLKAFIGFFLFGFSYYKRPWQANRPQSKTGIGIGAFNLISKKAYEDAGTHESIRMRPDDDLMLGMLMKRLGYRQKIAAALELLEVEWYTSLGEAFRGLEKNTFAGLHYRISMVLLAIAGTFISQVVPFFAVFSPDRLVMGLSAANIILLGGLYTMISNRMTPFSSALFLVFPLTALLFIYSIMRASFLTFKRGGIVWRGTKYSLKELRR

SEQ ID NO: 141 - protein, 347 aa, Symbiobacterium thermophilum IAM 14863
PNASLGPNPPPRVSAIVPACNEARSIESAVRSLIRQDYPNLEVVLVNDRSTDGTGAIMDRLAREFPQVTVVHIDRLPAGWLGKNHALWVGARHASGEILLFTDADVHYDPTTVRRAVAFMEQRRLDHLTLAPDLTVRGYWLEAWVGFFVMAFLAYKTPYRANDPRSKVGTGIGAFNMIRRTAYEAIGTHRAISLRPDDDLRLGQRLKRMGHSSHVAMGRGLVSVEWYTSLREAIRGLEKNAFAGLEYNLGTVFASVVGILAIMVWPYVALFLTEGWTLGLYAGAILLQLALYVLANGAGGPRMCQLALAYPVAALLFAYAIARATYLTLRRGGIAWRGTFYPLALLR

SEQ ID NO: 142 - protein, 392 aa, Acidobacteria bacterium Ellin345
IWWHAHWEALVAFAIGLVWLSRLLAASRGMPKLAEISRPEWDLRPDPAPRVSIVVCALNEEGKIEPALRSLLELDYPDYEVVAVDDRSTDRTGEIMDRIAEEYRANAHHHLRVVHVTELPPGWLGKVHAMWSATRVADGDWILFTDADVVFQKETLRRAIAYAERERADHVVLFPTMLMYTWDERMMIAFFQAMFVFGHRPWKTADPKSRDHMGVGAFNLIRRSVYEKIGTYARMKMAVVDDMKLGEIVKKEGYAQRNVFGRDLIQLHWHSGALGVVRGLTKNFFAILRFNPFLTLGVILGMLLFNLTPFVGVFLTHGWARAGYALALASIAGIYYGMSDRSTIPWYYVVLHPVSTVLFAYTVGRSMVVTLAQDGITWRGTHYSLNELRKGV

SEQ ID NO: 143 - protein, 373 aa, Anaeromyxobacter sp. K
ALALAGWARVAWSGLRSDRALARLEDLPAPRSVPRVSVVVPCRDEAPHVERAVRSLLAQDLPGLEVVAVDDRSRDETGAILDRLAAAEPRLAVVHVRELPAGWLGKNHACAAGARRARGEWLLFTDGDVVFGPGALRRAVGHAEALGLGHLAAAPRFVAPGALERAFVAAFAAFAAGAFRVWELPRAGTRGFAGVGAFNLVRRDAYEAVGGHARLRLEVVDDVKLGLLLRRSGVPQGLVNGGALVSVRWQHGFVPSVLGLVKNAFAGAEYRVARALGVALWAVFLGAAPLALALAAHGGAARALGGLALAVSVGVLGVTARRVAGGGGAEGLLMPPCTVLLGAVLLASAAAAAWRGGVVWRGTFYPLAALRQG

SEQ ID NO: 144 - protein, 397 aa, Artificial
  Substituion in SEQ ID NO 137
MFSNFVWSWLAHALPRAAWLPVLCAVVWTAIFLRTIPDLVRTPRLRPREAARASPPSYGRVSVVVAARDEREHIEVTLESLLKQTYPDLEIVAVDDRSTDGTGDVIDRMAASDSRIVPVHIRELPRGWLGKNHALYAGAMRATGDWLLFADADVRFYPDAVERAMAYVHAHRLHHLTVAPRLIASGYALKLLTAMYIFNYVLFKRPQSAYRRRTRAHAGIGAFNLVSREAYERIGTHRAISLRPDDDLHLGKLIKRHGFRQRFVVAQDMIEIEWYPSFRAMVVGMEKAPLPAFHYSAVLLTAAMMVMMVLYTTPFAGAIFGPGWYRLVYLYCLVLMGILYELHAVFLRLPKHQFLILPLGMLLYSYAFIRSAVLAVRRGGLVWRDTFYTLRELRRGL

SEQ ID NO: 145 - protein, 397 aa, Artificial
  Substituion in SEQ ID NO 137
MFSNFVWSWLAHALPRAAWLPVLCAVVWTAIFLRTIPDLVRTPRLRPREAARASPPSYGRVSVVVAARDEREHIEVTLESILRQTYPDLEIVAVDDRSTDGTGDVIDRMAASDSRIVPVHIRELPRGWLGKNHALYAGAMRATGDWLLFADADVRFYPDAVERAMAYVHAHRLHHLTVAPRLIASGYALKLLTAMYIFNYVLFKRPQSAYRRRTRAHAGIGAFNLVSREAYERIGTHRAISLRPDDDLHLGKLIKRHGFRQRFVVAQDMIEIEWYPSFRAMVVGMEKAPLPAFHYSAVLLTAAMMVMMVLYTTPFAGAIFGPGWYRLVYLYCLVLMGILYELHAVFLRLPKHQFLILPLGMLLYSYAFIRSAVLAVRRGGLVWRDTFYTLRELRRGL

SEQ ID NO: 146 - protein, 397 aa, Artificial
  Substituion in SEQ ID NO 137
MFSNFVWSWLAHALPRAAWLPVLCAVVWTAIFLRTIPDLVRTPRLRPREAARASPPSYGRVSVVVAARDEREHIEVTLESLLRQTYPDLEIVAVDDRSTDGTGDVIDRMAASDSRIVPVHIRELPRGWLGKNHALYAGAMRATGDWLLFADADVRFYPDAVERAMAYVHAHRLHHLTVAPRLIASGYALKLLTAMYIFNYVLFKRPQSAYRRKTRAHAGIGAFNLVSREAYERIGTHRAISLRPDDDLHLGKLIKRHGFRQRFVVAQDMIEIEWYPSFRAMVVGMEKAPLPAFHYSAVLLTAAMMVMMVLYTTPFAGAIFGPGWYRLVYLYCLVLMGILYELHAVFLRLPKHQFLILPLGMLLYSYAFIRSAVLAVRRGGLVWRDTFYTLRELRRGL

SEQ ID NO: 147 - protein, 397 aa, Artificial
  Substituion in SEQ ID NO 137
MFSNFVWSWLAHALPRAAWLPVLCAVVWTAIFLRTIPDLVRTPRLRPREAARASPPSYGKVSVVVAARDEREHIEVTLESLLRQTYPDLEIVAVDDRSTDGTGDVIDRMAASDSRIVPVHIRELPRGWLGKNHALYAGAMRATGDWLLFADADVRFYPDAVERAMAYVHAHRLHHLTVAPRLIASGYALKLLTAMYIFNYVLFKRPQSAYRRRTRAHAGIGAFNLVSREAYERIGTHRAISLRPDDDLHLGKLIKRHGFRQRFVVAQDMIEIEWYPSFRAMVVGMEKAPLPAFHYSAVLLTAAMMVMMVLYTTPFAGAIFGPGWYRLVYLYCLVLMGILYELHAVFLRLPKHQFLILPLGMLLYSYAFIRSAVLAVRRGGLVWRDTFYTLRELRRGL

SEQ ID NO: 148 - protein, 397 aa, Artificial
  Substituion in SEQ ID NO 137
MFSNFVWSWLAHALPRAAWLPVICAVVWTAIFLRTIPDLVRTPRLRPREAARASPPSYGRVSVVVAARDEREHIEVTLESLLRQTYPDLEIVAVDDRSTDGTGDVIDRMAASDSRIVPVHIRELPRGWLGKNHALYAGAMRATGDWLLFADADVRFYPDAVERAMAYVHAHRLHHLTVAPRLIASGYALKLLTAMYIFNYVLFKRPQSAYRRRTRAHAGIGAFNLVSREAYERIGTHRAISLRPDDDLHLGKLIKRHGFRQRFVVAQDMIEIEWYPSFRAMVVGMEKAPLPAFHYSAVLLTAAMMVMMVLYTTPFAGAIFGPGWYRLVYLYCLVLMGILYELHAVFLRLPKHQFLILPLGMLLYSYAFIRSAVLAVRRGGLVWRDTFYTLRELRRGL

SEQ ID NO: 149 - DNA, 1194 bp, Artificial
  Substituion in SEQ ID NO 138
atgttctccaacttcgtgtggtcctggcttgcgcacgcgcttccgcgggcggcgtggctgcccgtcctgtgcgcggtggtgtggacggccatctttctccgcaccatcccggacctcgtgcgaacgccgcgccttcggccccgtgaggcggcgagagcgagcccaccgtcctatggccgcgtgagcgtcgtggtggcggcgcgcgatgagcgggagcacatcgaggtcacgctcgaatcgctgctgaaacagacgtatccggatctcgaaatcgtcgcggttgacgatcggtcgacggacgggacgggcgacgtgatcgaccggatggcggccagcgattcgcgcattgtgccggtgcacatccgagagctgccgcgtggatggctgggcaagaaccacgccctgtatgcaggcgctatgcgcgcgacgggcgattggctgctgtttgcggacgcggacgtgcggttttacccggacgcggtggaacgggccatggcctacgtgcacgcgcatcggctgcatcacctgaccgtggcgccgaggctcatcgcatccggctacgcgctgaagctattgacggccatgtacatcttcaactatgtgctgttcaagcggccccagagcgcgtaccgcaggcgcactcgcgcacacgccggcatcggcgcgttcaacctcgtcagccgcgaggcgtacgagcgcatcggcacgcatcgagccatcagcttacgtcccgacgacgatctccacctcggcaagctcatcaagcggcatggatttcggcagcgattcgtcgtggcgcaggacatgatcgagatcgagtggtatccgagcttccgcgcgatggtcgtcggcatggagaaagcgccgctgccggcatttcactattccgcggtgcttttgacggcggccatgatggtgatgatggtgctctacacgacgcctttcgcaggggccatcttcggaccgggttggtatcgattggtttatctgtattgtctcgtcctcatgggaatcttatatgaacttcatgcggtgtttttgagactgcccaagcaccagttcctcatcctgccgctcggcatgctgctgtacagctacgccttcattcgttcggccgtgctggcggttcgccgaggagggctcgtgtggcgggacacgttttacacgctgcgcgaactgcgccgaggtctgtga

SEQ ID NO: 150 - DNA, 1194 bp, Artificial
  Substituion in SEQ ID NO 138
atgttctccaacttcgtgtggtcctggcttgcgcacgcgcttccgcgggcggcgtggctgcccgtcctgtgcgcggtggtgtggacggccatctttctccgcaccatcccggacctcgtgcgaacgccgcgccttcggccccgtgaggcggcgagagcgagcccaccgtcctatggccgcgtgagcgtcgtggtggcggcgcgcgatgagcgggagcacatcgaggtcacgctcgaatcgattctgcgccagacgtatccggatctcgaaatcgtcgcggttgacgatcggtcgacggacgggacgggcgacgtgatcgaccggatggcggccagcgattcgcgcattgtgccggtgcacatccgagagctgccgcgtggatggctgggcaagaaccacgccctgtatgcaggcgctatgcgcgcgacgggcgattggctgctgtttgcggacgcggacgtgcggttttacccggacgcggtggaacgggccatggcctacgtgcacgcgcatcggctgcatcacctgaccgtggcgccgaggctcatcgcatccggctacgcgctgaagctattgacggccatgtacatcttcaactatgtgctgttcaagcggccccagagcgcgtaccgcaggcgcactcgcgcacacgccggcatcggcgcgttcaacctcgtcagccgcgaggcgtacgagcgcatcggcacgcatcgagccatcagcttacgtcccgacgacgatctccacctcggcaagctcatcaagcggcatggatttcggcagcgattcgtcgtggcgcaggacatgatcgagatcgagtggtatccgagcttccgcgcgatggtcgtcggcatggagaaagcgccgctgccggcatttcactattccgcggtgcttttgacggcggccatgatggtgatgatggtgctctacacgacgcctttcgcaggggccatcttcggaccgggttggtatcgattggtttatctgtattgtctcgtcctcatgggaatcttatatgaacttcatgcggtgtttttgagactgcccaagcaccagttcctcatcctgccgctcggcatgctgctgtacagctacgccttcattcgttcggccgtgctggcggttcgccgaggagggctcgtgtggcgggacacgttttacacgctgcgcgaactgcgccgaggtctgtga

SEQ ID NO: 151 - DNA, 1194 bp, Artificial
  Substituion in SEQ ID NO 138
atgttctccaacttcgtgtggtcctggcttgcgcacgcgcttccgcgggcggcgtggctgcccgtcctgtgcgcggtggtgtggacggccatctttctccgcaccatcccggacctcgtgcgaacgccgcgccttcggccccgtgaggcggcgagagcgagcccaccgtcctatggccgcgtgagcgtcgtggtggcggcgcgcgatgagcgggagcacatcgaggtcacgctcgaatcgctgctgcgccagacgtatccggatctcgaaatcgtcgcggttgacgatcggtcgacggacgggacgggcgacgtgatcgaccggatggcggccagcgattcgcgcattgtgccggtgcacatccgagagctgccgcgtggatggctgggcaagaaccacgccctgtatgcaggcgctatgcgcgcgacgggcgattggctgctgtttgcggacgcggacgtgcggttttacccggacgcggtggaacgggccatggcctacgtgcacgcgcatcggctgcatcacctgaccgtggcgccgaggctcatcgcatccggctacgcgctgaagctattgacggccatgtacatcttcaactatgtgctgttcaagcggccccagagcgcgtaccgcaggaaaactcgcgcacacgccggcatcggcgcgttcaacctcgtcagccgcgaggcgtacgagcgcatcggcacgcatcgagccatcagcttacgtcccgacgacgatctccacctcggcaagctcatcaagcggcatggatttcggcagcgattcgtcgtggcgcaggacatgatcgagatcgagtggtatccgagcttccgcgcgatggtcgtcggcatggagaaagcgccgctgccggcatttcactattccgcggtgcttttgacggcggccatgatggtgatgatggtgctctacacgacgcctttcgcaggggccatcttcggaccgggttggtatcgattggtttatctgtattgtctcgtcctcatgggaatcttatatgaacttcatgcggtgtttttgagactgcccaagcaccagttcctcatcctgccgctcggcatgctgctgtacagctacgccttcattcgttcggccgtgctggcggttcgccgaggagggctcgtgtggcgggacacgttttacacgctgcgcgaactgcgccgaggtctgtga

SEQ ID NO: 152 - DNA, 1194 bp, Artificial
  Substituion in SEQ ID NO 138
atgttctccaacttcgtgtggtcctggcttgcgcacgcgcttccgcgggcggcgtggctgcccgtcctgtgcgcggtggtgtggacggccatctttctccgcaccatcccggacctcgtgcgaacgccgcgccttcggccccgtgaggcggcgagagcgagcccaccgtcctatggcaaagtgagcgtcgtggtggcggcgcgcgatgagcgggagcacatcgaggtcacgctcgaatcgctgctgcgccagacgtatccggatctcgaaatcgtcgcggttgacgatcggtcgacggacgggacgggcgacgtgatcgaccggatggcggccagcgattcgcgcattgtgccggtgcacatccgagagctgccgcgtggatggctgggcaagaaccacgccctgtatgcaggcgctatgcgcgcgacgggcgattggctgctgtttgcggacgcggacgtgcggttttacccggacgcggtggaacgggccatggcctacgtgcacgcgcatcggctgcatcacctgaccgtggcgccgaggctcatcgcatccggctacgcgctgaagctattgacggccatgtacatcttcaactatgtgctgttcaagcggccccagagcgcgtaccgcaggcgcactcgcgcacacgccggcatcggcgcgttcaacctcgtcagccgcgaggcgtacgagcgcatcggcacgcatcgagccatcagcttacgtcccgacgacgatctccacctcggcaagctcatcaagcggcatggatttcggcagcgattcgtcgtggcgcaggacatgatcgagatcgagtggtatccgagcttccgcgcgatggtcgtcggcatggagaaagcgccgctgccggcatttcactattccgcggtgcttttgacggcggccatgatggtgatgatggtgctctacacgacgcctttcgcaggggccatcttcggaccgggttggtatcgattggtttatctgtattgtctcgtcctcatgggaatcttatatgaacttcatgcggtgtttttgagactgcccaagcaccagttcctcatcctgccgctcggcatgctgctgtacagctacgccttcattcgttcggccgtgctggcggttcgccgaggagggctcgtgtggcgggacacgttttacacgctgcgcgaactgcgccgaggtctgtga

SEQ ID NO: 153 - DNA, 1194 bp, Artificial
  Substituion in SEQ ID NO 138
atgttctccaacttcgtgtggtcctggcttgcgcacgcgcttccgcgggcggcgtggctgcccgtcatttgcgcggtggtgtggacggccatctttctccgcaccatcccggacctcgtgcgaacgccgcgccttcggccccgtgaggcggcgagagcgagcccaccgtcctatggccgcgtgagcgtcgtggtggcggcgcgcgatgagcgggagcacatcgaggtcacgctcgaatcgctgctgcgccagacgtatccggatctcgaaatcgtcgcggttgacgatcggtcgacggacgggacgggcgacgtgatcgaccggatggcggccagcgattcgcgcattgtgccggtgcacatccgagagctgccgcgtggatggctgggcaagaaccacgccctgtatgcaggcgctatgcgcgcgacgggcgattggctgctgtttgcggacgcggacgtgcggttttacccggacgcggtggaacgggccatggcctacgtgcacgcgcatcggctgcatcacctgaccgtggcgccgaggctcatcgcatccggctacgcgctgaagctattgacggccatgtacatcttcaactatgtgctgttcaagcggccccagagcgcgtaccgcaggcgcactcgcgcacacgccggcatcggcgcgttcaacctcgtcagccgcgaggcgtacgagcgcatcggcacgcatcgagccatcagcttacgtcccgacgacgatctccacctcggcaagctcatcaagcggcatggatttcggcagcgattcgtcgtggcgcaggacatgatcgagatcgagtggtatccgagcttccgcgcgatggtcgtcggcatggagaaagcgccgctgccggcatttcactattccgcggtgcttttgacggcggccatgatggtgatgatggtgctctacacgacgcctttcgcaggggccatcttcggaccgggttggtatcgattggtttatctgtattgtctcgtcctcatgggaatcttatatgaacttcatgcggtgtttttgagactgcccaagcaccagttcctcatcctgccgctcggcatgctgctgtacagctacgccttcattcgttcggccgtgctggcggttcgccgaggagggctcgtgtggcgggacacgttttacacgctgcgcgaactgcgccgaggtctgtga

SEQ ID NO: 154 - protein, 470 aa, Alicyclobacillus acidocaldarius
MNFANEKFRLSLGHVPSEMHCAQHIRIEARGAVREFARSGAGTRPDRRGGSSSPVRSKRRMVHSFLFLYPFVMSIVWMVGGCVYAWRRERHPFAESPDLPETPFVSILIPCHNEGDVLEDTIGRMLQLDYPAYEIVALNDGSTDDTRAVLERMAACDARVRVVNLPVQRGKARALNAGLVASRGEILVTVDADAVLAKDALRFLVWHFVAPGSERVGAVTGNPRIRNRGTLLGKIQVLEYASIIGLIKRAQRVLGKIMTVSGVIAAFRKRALVDCGMWDEDMVTDDIAVSWKLERRAWDIRYEPRALCFMWAPERLRSLIRQRARWAQGGVEVLIRNASVLWTWKNRRMIPLYVEELLGIAWAYLWVVSLVWTLAFDVAHGIPWTYVAETGTWLGLTSLVQTSVALWIEQRYERDSLWRYYFYAIWYPAAYWMIGAFVVVWAVPKACWAMWAARRGRYATWKSPDRGVSA

SEQ ID NO: 155 - DNA, 1413 bp, Alicyclobacillus acidocaldarius
ttgaacttcgctaatgaaaaatttaggctgtcgcttgggcatgtgccgtcggaaatgcattgcgcacaacatattcgtatcgaagctcgcggagcggtccgcgagttcgcgcgatccggcgcagggactcggccggatcgccgcggtggaagctcgagtccagtgaggagcaaacggcgcatggtgcattcttttctgttcctgtatccctttgtcatgagcatcgtctggatggtgggcggctgtgtctatgcctggcggcgcgaacgccaccccttcgccgaatccccggacctccccgagacgccgtttgtttccatcctcatcccctgccacaacgaaggggatgtgctcgaagacaccatcggccggatgcttcagttggattatccggcgtacgaaattgtcgcactgaacgacggcagcacggacgacacgcgcgcggtgctcgaacgcatggcggcctgcgatgcgcgagttcgcgtggtcaacctgcccgttcagcgcggaaaggcgcgcgcgctgaacgctgggcttgtcgcgtcccgaggcgagatcctcgtgaccgtggacgcggacgccgtgttggcgaaggacgcgcttcgcttcctcgtctggcacttcgtggccccgggcagcgagcgcgtcggtgccgtgacgggcaacccgcgcattcgaaatcgcggtacgctgctcggaaagattcaggtgctggagtacgcgagcatcatcgggctcatcaagcgcgcgcagcgcgtgctcggcaagatcatgacggtctcgggcgtgattgcggcctttcgcaagagggccctcgtggactgcggcatgtgggacgaggacatggtgacggatgacatcgcggtgtcctggaagctcgagcggcgagcctgggacatccgatacgagccgcgagcgctctgcttcatgtgggcgcccgagcgcctgcggagcctcatccgccagcgcgctcgctgggcgcagggcggcgtggaggtcctcatccgcaacgcctcggtcctctggacctggaagaatcggcgcatgatcccgctctatgtggaagagctcctgggcatcgcctgggcgtacctttgggttgtgagcctcgtgtggaccctcgcatttgacgtggcgcacggcattccctggacgtacgtggcggagacggggacgtggctcggcctgacatcgttagtgcagacctcggtcgccctttggattgagcagcgatacgagcgcgactcgctctggcgctactatttctatgccatctggtatccggccgcgtattggatgatcggcgcgttcgtcgtggtctgggcggtgccgaaggcgtgctgggccatgtgggcggctcggcgcgggcggtacgccacgtggaaaagcccggatcggggggtgtcggcatga

SEQ ID NO: 156 - protein, 401 aa, Thermosinus carboxydivorans Nor1
FVFYYPLVMSIVWIVGAFYFYLRREAGRRRRPPVLAEYPLVSVLIPAHNEEQSIRATIASVLKSNYPNFEIVVVDDGSTDATPRILLELAAECPAVRVLIMKQNMGKPSALRYGLMACRGEIILAMDADAFLDANAMRWLVAHFVAGPRVGAVTGNPRVRNRTSLIAKIQVGEYSSIIGMIKRTQRILGKVLTVSGVIAAFRKRALLDVGLWDIDMITDDINVTWKLEKHFWDVRYEPNALCWILVPETLKGLWRQRVRWAQGGVEVIRRHAGIWTDWRQRRLWPVYIEYVISVCWSYAFVSFGGLWLLNFIFPHDLPVAKIFPEWKGAVLVSLCLVQSAIALWIDRRYEKNILWYYFWVIWYPFVYWVISALATVWAAPRALFGHSKGKLAVWQSPDRGL

SEQ ID NO: 157 - protein, 410 aa, Stenotrophomonas maltophilia R551-3
QVLFQFAFYYPMVMAFFWMSGGLYYYFRRERHSRPRNDPPLMIDPPFASLLIPCHNESENLDDTLGAALAQRYPADYEVIAIDDGSSDDTGARLDALAAKHPRLRVLHLDRNLGKANALRMGALAARSEYLVCIDGDAMLEEHALHWMIWHLVSGSRVGAVTGNPRIRNRSTLLGRLQVAEFSSIIGMIKRAQRVYGRIFTISGVIAGFRRTALHQVGWWSDDMVTEDIDISWRLQRAHWDIRYEPNALCFILMPETLKGLWRQRLRWAQGGVEVMLRHARSLLHWKERRMWGVLLEYVLSVVWAYTMLFIVVLWALGKFIEMPPQLYIASLLAQWHGVILALVCLLQFASSLIIDRRYETQIGRNYFWVIWYPMAYWLISLSTTLVALPKTLLRRRSKRATWTSPDRGI

SEQ ID NO: 158 - protein, 404 aa, Xanthomonas oryzae pv. oryzae KACC10331
FAFFYPIMMAFFWISGGLYYFLRRERKSRPRNDPPPMGHYPSASLLIPCHNESDNLDDTIGNALAQRYPDFEVIAINDGSRDDTGARLDILAARHPRLRVIHLDRNLGKANALRMGALAARSEYLICIDGDAMLEEFAMHWMVWHLSSSPRVGAVTGNPRIRNRSTLLGRLQVAEFSSIIGMIKRAQRVYGRIFTVSGVIAGFRRTALHRIGYWADDMMTEDIDISWRLQLDHWDIRYEPNALCFILMPETLKGLWRQRLRWAQGGVEVLLRHGRSLFSWRKRRMWGVLLEYILSVLWAYSIVLIAVLWAPRQFFALPTAVSIHGLLPQWHGAAMVLVCLLQFASSLIIDRRYEKGIGRNYFWVIWYPIAYWLLSLCTTVVALPKTLLTRRGKRAIWVSPDRGI

SEQ ID NO: 159 - protein, 404 aa, Xanthomonas oryzae pv. oryzae MAFF 311018; identical to SEQ ID NO: 158

SEQ ID NO: 160 - protein, 404 aa, Xanthomonas oryzae pv. oryzicola BLS256
FAFFYPIMMAFFWISGGLYYFLRRERKSRPRNNPPPMGHYPSASLLIPCHNESENLDDTIGSALAQRYPDFEVIAINDGSRDDTGARLDILAARHPRLRVIHLDRNLGKANALRMGALAARSEYLICIDGDAMLGEFAMHWMVWHLSSSPRVGAVTGNPRIRNRSTLLGRLQVAEFSSIIGMIKRAQRVYGRIFTVSGVIAGFRRTALHRIGYWADDMMTEDIDISWRLQLDHWDIRYEPNALCFILMPETLKGLWRQRLRWAQGGVEVLLRHGRSLFSWRKRRMWGVLLEYILSVLWAYSIVLIAVLWAPRQFFALPTALSIHGLLPQWHGAAMVLVCLLQFASSLIIDRRYEKGIGRNYFWVIWYPIAYWLLSLCTTVVALPKTLLTRRGKRAIWVSPDRGI

SEQ ID NO: 161 - protein, 470 aa, Artificial
  Substituion in SEQ ID NO 154
MNFANEKFRLSLGHVPSEMHCAQHIRIEARGAVREFARSGAGTRPDRRGGSSSPVRSKRRMVHSFLFLYPFVMSIVWMVGGCVYAWRRERHPFADSPDLPETPFVSILIPCHNEGDVLEDTIGRMLQLDYPAYEIVALNDGSTDDTRAVLERMAACDARVRVVNLPVQRGKARALNAGLVASRGEILVTVDADAVLAKDALRFLVWHFVAPGSERVGAVTGNPRIRNRGTLLGKIQVLEYASIIGLIKRAQRVLGKIMTVSGVIAAFRKRALVDCGMWDEDMVTDDIAVSWKLERRAWDIRYEPRALCFMWAPERLRSLIRQRARWAQGGVEVLIRNASVLWTWKNRRMIPLYVEELLGIAWAYLWVVSLVWTLAFDVAHGIPWTYVAETGTWLGLTSLVQTSVALWIEQRYERDSLWRYYFYAIWYPAAYWMIGAFVVVWAVPKACWAMWAARRGRYATWKSPDRGVSA

SEQ ID NO: 162 - protein, 470 aa, Artificial
  Substituion in SEQ ID NO 154
MNFANEKFRLSLGHVPSEMHCAQHIRIEARGAVREFARSGAGTRPDRRGGSSSPVRSKRRMVHSFLFLYPFVMSIVWMVGGCVYAWRRERHPFAESPDLPETPFVSILIPCHNEGDVLEDTIGRMLQLDYPAYEIVALNDGSTDDTRAVLERMAACDARVRVVNLPVQRGKARALNAGLVASRGEILVTVDADAVLAKDALRFLVWHFVAPGSERVGAVTGNPRIRNRGTLLGKIQVLEYASIIGLIKRAQRVLGKIMTVSGVIAAFRKRALVDCGMWDEDMVTDDIAVSWKLERRAWDIRYEPRALCFMWAPERLRSLIRQRARWAQGGVEVLIRNASVLWTWKNRRMIPLYVEELLGIAWAYLWVISLVWTLAFDVAHGIPWTYVAETGTWLGLTSLVQTSVALWIEQRYERDSLWRYYFYAIWYPAAYWMIGAFVVVWAVPKACWAMWAARRGRYATWKSPDRGVSA

SEQ ID NO: 163 - protein, 470 aa, Artificial
  Substituion in SEQ ID NO 154
MNFANEKFRLSLGHVPSEMHCAQHIRIEARGAVREFARSGAGTKPDRRGGSSSPVRSKRRMVHSFLFLYPFVMSIVWMVGGCVYAWRRERHPFAESPDLPETPFVSILIPCHNEGDVLEDTIGRMLQLDYPAYEIVALNDGSTDDTRAVLERMAACDARVRVVNLPVQRGKARALNAGLVASRGEILVTVDADAVLAKDALRFLVWHFVAPGSERVGAVTGNPRIRNRGTLLGKIQVLEYASIIGLIKRAQRVLGKIMTVSGVIAAFRKRALVDCGMWDEDMVTDDIAVSWKLERRAWDIRYEPRALCFMWAPERLRSLIRQRARWAQGGVEVLIRNASVLWTWKNRRMIPLYVEELLGIAWAYLWVVSLVWTLAFDVAHGIPWTYVAETGTWLGLTSLVQTSVALWIEQRYERDSLWRYYFYAIWYPAAYWMIGAFVVVWAVPKACWAMWAARRGRYATWKSPDRGVSA

SEQ ID NO: 164 - protein, 470 aa, Artificial
  Substituion in SEQ ID NO 154
MNFANEKFRLSLGHVPSEMHCAQHIRIEARGAVREFARSGAGTRPDRRGGSSSPVRSKRRMVHSFLFLYPFVMSIVWMVGGCVYAWRRERHPFAESPDLPETPFVSILIPCHNEGDVLEDTIGRMLQLDYPAYEIVALNDGSTDDTRAVLERMAACDARVRVVNLPVQRGKARALNAGLVASRGEILVTVDADAVLAKDALRFLVWHFVAPGSERVGAVTGNPRIRNRGTLLGKIQVLEYASIIGLIKRAQRVLGKIMTVSGVIAAFRKRALVDCGMWDEDMVTDDIAVSWKLERRAWDIRYEPRALCFMWAPERLRSLIRQRARWAQGGVEVLIRNASVLWTWKNRRMIPLYVEELLGIAWAYLWVVSLVWTLAFDVAHGIPWTYVAETGTWLGLTSLVQTSVALWIEQRYERESLWRYYFYAIWYPAAYWMIGAFVVVWAVPKACWAMWAARRGRYATWKSPDRGVSA

SEQ ID NO: 165 - protein, 470 aa, Artificial
  Substituion in SEQ ID NO 154
MQFANEKFRLSLGHVPSEMHCAQHIRIEARGAVREFARSGAGTRPDRRGGSSSPVRSKRRMVHSFLFLYPFVMSIVWMVGGCVYAWRRERHPFAESPDLPETPFVSILIPCHNEGDVLEDTIGRMLQLDYPAYEIVALNDGSTDDTRAVLERMAACDARVRVVNLPVQRGKARALNAGLVASRGEILVTVDADAVLAKDALRFLVWHFVAPGSERVGAVTGNPRIRNRGTLLGKIQVLEYASIIGLIKRAQRVLGKIMTVSGVIAAFRKRALVDCGMWDEDMVTDDIAVSWKLERRAWDIRYEPRALCFMWAPERLRSLIRQRARWAQGGVEVLIRNASVLWTWKNRRMIPLYVEELLGIAWAYLWVVSLVWTLAFDVAHGIPWTYVAETGTWLGLTSLVQTSVALWIEQRYERDSLWRYYFYAIWYPAAYWMIGAFVVVWAVPKACWAMWAARRGRYATWKSPDRGVSA

SEQ ID NO: 166 - DNA, 1413 bp, Artificial
  Substituion in SEQ ID NO 155
ttgaacttcgctaatgaaaaatttaggctgtcgcttgggcatgtgccgtcggaaatgcattgcgcacaacatattcgtatcgaagctcgcggagcggtccgcgagttcgcgcgatccggcgcagggactcggccggatcgccgcggtggaagctcgagtccagtgaggagcaaacggcgcatggtgcattcttttctgttcctgtatccctttgtcatgagcatcgtctggatggtgggcggctgtgtctatgcctggcggcgcgaacgccaccccttcgccgattccccggacctccccgagacgccgtttgtttccatcctcatcccctgccacaacgaaggggatgtgctcgaagacaccatcggccggatgcttcagttggattatccggcgtacgaaattgtcgcactgaacgacggcagcacggacgacacgcgcgcggtgctcgaacgcatggcggcctgcgatgcgcgagttcgcgtggtcaacctgcccgttcagcgcggaaaggcgcgcgcgctgaacgctgggcttgtcgcgtcccgaggcgagatcctcgtgaccgtggacgcggacgccgtgttggcgaaggacgcgcttcgcttcctcgtctggcacttcgtggccccgggcagcgagcgcgtcggtgccgtgacgggcaacccgcgcattcgaaatcgcggtacgctgctcggaaagattcaggtgctggagtacgcgagcatcatcgggctcatcaagcgcgcgcagcgcgtgctcggcaagatcatgacggtctcgggcgtgattgcggcctttcgcaagagggccctcgtggactgcggcatgtgggacgaggacatggtgacggatgacatcgcggtgtcctggaagctcgagcggcgagcctgggacatccgatacgagccgcgagcgctctgcttcatgtgggcgcccgagcgcctgcggagcctcatccgccagcgcgctcgctgggcgcagggcggcgtggaggtcctcatccgcaacgcctcggtcctctggacctggaagaatcggcgcatgatcccgctctatgtggaagagctcctgggcatcgcctgggcgtacctttgggttgtgagcctcgtgtggaccctcgcatttgacgtggcgcacggcattccctggacgtacgtggcggagacggggacgtggctcggcctgacatcgttagtgcagacctcggtcgccctttggattgagcagcgatacgagcgcgactcgctctggcgctactatttctatgccatctggtatccggccgcgtattggatgatcggcgcgttcgtcgtggtctgggcggtgccgaaggcgtgctgggccatgtgggcggctcggcgcgggcggtacgccacgtggaaaagcccggatcggggggtgtcggcatga

SEQ ID NO: 167 - DNA, 1413 bp, Artificial
  Substituion in SEQ ID NO 155
ttgaacttcgctaatgaaaaatttaggctgtcgcttgggcatgtgccgtcggaaatgcattgcgcacaacatattcgtatcgaagctcgcggagcggtccgcgagttcgcgcgatccggcgcagggactcggccggatcgccgcggtggaagctcgagtccagtgaggagcaaacggcgcatggtgcattcttttctgttcctgtatccctttgtcatgagcatcgtctggatggtgggcggctgtgtctatgcctggcggcgcgaacgccaccccttcgccgaatccccggacctccccgagacgccgtttgtttccatcctcatcccctgccacaacgaaggggatgtgctcgaagacaccatcggccggatgcttcagttggattatccggcgtacgaaattgtcgcactgaacgacggcagcacggacgacacgcgcgcggtgctcgaacgcatggcggcctgcgatgcgcgagttcgcgtggtcaacctgcccgttcagcgcggaaaggcgcgcgcgctgaacgctgggcttgtcgcgtcccgaggcgagatcctcgtgaccgtggacgcggacgccgtgttggcgaaggacgcgcttcgcttcctcgtctggcacttcgtggccccgggcagcgagcgcgtcggtgccgtgacgggcaacccgcgcattcgaaatcgcggtacgctgctcggaaagattcaggtgctggagtacgcgagcatcatcgggctcatcaagcgcgcgcagcgcgtgctcggcaagatcatgacggtctcgggcgtgattgcggcctttcgcaagagggccctcgtggactgcggcatgtgggacgaggacatggtgacggatgacatcgcggtgtcctggaagctcgagcggcgagcctgggacatccgatacgagccgcgagcgctctgcttcatgtgggcgcccgagcgcctgcggagcctcatccgccagcgcgctcgctgggcgcagggcggcgtggaggtcctcatccgcaacgcctcggtcctctggacctggaagaatcggcgcatgatcccgctctatgtggaagagctcctgggcatcgcctgggcgtacctttgggttattagcctcgtgtggaccctcgcatttgacgtggcgcacggcattccctggacgtacgtggcggagacggggacgtggctcggcctgacatcgttagtgcagacctcggtcgccctttggattgagcagcgatacgagcgcgactcgctctggcgctactatttctatgccatctggtatccggccgcgtattggatgatcggcgcgttcgtcgtggtctgggcggtgccgaaggcgtgctgggccatgtgggcggctcggcgcgggcggtacgccacgtggaaaagcccggatcggggggtgtcggcatga

SEQ ID NO: 168 - DNA, 1413 bp, Artificial
  Substituion in SEQ ID NO 155
ttgaacttcgctaatgaaaaatttaggctgtcgcttgggcatgtgccgtcggaaatgcattgcgcacaacatattcgtatcgaagctcgcggagcggtccgcgagttcgcgcgatccggcgcagggactaaaccggatcgccgcggtggaagctcgagtccagtgaggagcaaacggcgcatggtgcattcttttctgttcctgtatccctttgtcatgagcatcgtctggatggtgggcggctgtgtctatgcctggcggcgcgaacgccaccccttcgccgaatccccggacctccccgagacgccgtttgtttccatcctcatcccctgccacaacgaaggggatgtgctcgaagacaccatcggccggatgcttcagttggattatccggcgtacgaaattgtcgcactgaacgacggcagcacggacgacacgcgcgcggtgctcgaacgcatggcggcctgcgatgcgcgagttcgcgtggtcaacctgcccgttcagcgcggaaaggcgcgcgcgctgaacgctgggcttgtcgcgtcccgaggcgagatcctcgtgaccgtggacgcggacgccgtgttggcgaaggacgcgcttcgcttcctcgtctggcacttcgtggccccgggcagcgagcgcgtcggtgccgtgacgggcaacccgcgcattcgaaatcgcggtacgctgctcggaaagattcaggtgctggagtacgcgagcatcatcgggctcatcaagcgcgcgcagcgcgtgctcggcaagatcatgacggtctcgggcgtgattgcggcctttcgcaagagggccctcgtggactgcggcatgtgggacgaggacatggtgacggatgacatcgcggtgtcctggaagctcgagcggcgagcctgggacatccgatacgagccgcgagcgctctgcttcatgtgggcgcccgagcgcctgcggagcctcatccgccagcgcgctcgctgggcgcagggcggcgtggaggtcctcatccgcaacgcctcggtcctctggacctggaagaatcggcgcatgatcccgctctatgtggaagagctcctgggcatcgcctgggcgtacctttgggttgtgagcctcgtgtggaccctcgcatttgacgtggcgcacggcattccctggacgtacgtggcggagacggggacgtggctcggcctgacatcgttagtgcagacctcggtcgccctttggattgagcagcgatacgagcgcgactcgctctggcgctactatttctatgccatctggtatccggccgcgtattggatgatcggcgcgttcgtcgtggtctgggcggtgccgaaggcgtgctgggccatgtgggcggctcggcgcgggcggtacgccacgtggaaaagcccggatcggggggtgtcggcatga

SEQ ID NO: 169 - DNA, 1413 bp, Artificial
  Substituion in SEQ ID NO 155
ttgaacttcgctaatgaaaaatttaggctgtcgcttgggcatgtgccgtcggaaatgcattgcgcacaacatattcgtatcgaagctcgcggagcggtccgcgagttcgcgcgatccggcgcagggactcggccggatcgccgcggtggaagctcgagtccagtgaggagcaaacggcgcatggtgcattcttttctgttcctgtatccctttgtcatgagcatcgtctggatggtgggcggctgtgtctatgcctggcggcgcgaacgccaccccttcgccgaatccccggacctccccgagacgccgtttgtttccatcctcatcccctgccacaacgaaggggatgtgctcgaagacaccatcggccggatgcttcagttggattatccggcgtacgaaattgtcgcactgaacgacggcagcacggacgacacgcgcgcggtgctcgaacgcatggcggcctgcgatgcgcgagttcgcgtggtcaacctgcccgttcagcgcggaaaggcgcgcgcgctgaacgctgggcttgtcgcgtcccgaggcgagatcctcgtgaccgtggacgcggacgccgtgttggcgaaggacgcgcttcgcttcctcgtctggcacttcgtggccccgggcagcgagcgcgtcggtgccgtgacgggcaacccgcgcattcgaaatcgcggtacgctgctcggaaagattcaggtgctggagtacgcgagcatcatcgggctcatcaagcgcgcgcagcgcgtgctcggcaagatcatgacggtctcgggcgtgattgcggcctttcgcaagagggccctcgtggactgcggcatgtgggacgaggacatggtgacggatgacatcgcggtgtcctggaagctcgagcggcgagcctgggacatccgatacgagccgcgagcgctctgcttcatgtgggcgcccgagcgcctgcggagcctcatccgccagcgcgctcgctgggcgcagggcggcgtggaggtcctcatccgcaacgcctcggtcctctggacctggaagaatcggcgcatgatcccgctctatgtggaagagctcctgggcatcgcctgggcgtacctttgggttgtgagcctcgtgtggaccctcgcatttgacgtggcgcacggcattccctggacgtacgtggcggagacggggacgtggctcggcctgacatcgttagtgcagacctcggtcgccctttggattgagcagcgatacgagcgcgaatcgctctggcgctactatttctatgccatctggtatccggccgcgtattggatgatcggcgcgttcgtcgtggtctgggcggtgccgaaggcgtgctgggccatgtgggcggctcggcgcgggcggtacgccacgtggaaaagcccggatcggggggtgtcggcatga

SEQ ID NO: 170 - DNA, 1413 bp, Artificial
  Substituion in SEQ ID NO 155
ttgcaattcgctaatgaaaaatttaggctgtcgcttgggcatgtgccgtcggaaatgcattgcgcacaacatattcgtatcgaagctcgcggagcggtccgcgagttcgcgcgatccggcgcagggactcggccggatcgccgcggtggaagctcgagtccagtgaggagcaaacggcgcatggtgcattcttttctgttcctgtatccctttgtcatgagcatcgtctggatggtgggcggctgtgtctatgcctggcggcgcgaacgccaccccttcgccgaatccccggacctccccgagacgccgtttgtttccatcctcatcccctgccacaacgaaggggatgtgctcgaagacaccatcggccggatgcttcagttggattatccggcgtacgaaattgtcgcactgaacgacggcagcacggacgacacgcgcgcggtgctcgaacgcatggcggcctgcgatgcgcgagttcgcgtggtcaacctgcccgttcagcgcggaaaggcgcgcgcgctgaacgctgggcttgtcgcgtcccgaggcgagatcctcgtgaccgtggacgcggacgccgtgttggcgaaggacgcgcttcgcttcctcgtctggcacttcgtggccccgggcagcgagcgcgtcggtgccgtgacgggcaacccgcgcattcgaaatcgcggtacgctgctcggaaagattcaggtgctggagtacgcgagcatcatcgggctcatcaagcgcgcgcagcgcgtgctcggcaagatcatgacggtctcgggcgtgattgcggcctttcgcaagagggccctcgtggactgcggcatgtgggacgaggacatggtgacggatgacatcgcggtgtcctggaagctcgagcggcgagcctgggacatccgatacgagccgcgagcgctctgcttcatgtgggcgcccgagcgcctgcggagcctcatccgccagcgcgctcgctgggcgcagggcggcgtggaggtcctcatccgcaacgcctcggtcctctggacctggaagaatcggcgcatgatcccgctctatgtggaagagctcctgggcatcgcctgggcgtacctttgggttgtgagcctcgtgtggaccctcgcatttgacgtggcgcacggcattccctggacgtacgtggcggagacggggacgtggctcggcctgacatcgttagtgcagacctcggtcgccctttggattgagcagcgatacgagcgcgactcgctctggcgctactatttctatgccatctggtatccggccgcgtattggatgatcggcgcgttcgtcgtggtctgggcggtgccgaaggcgtgctgggccatgtgggcggctcggcgcgggcggtacgccacgtggaaaagcccggatcggggggtgtcggcatga

SEQ ID NO: 171 - protein, 366 aa, Alicyclobacillus acidocaldarius
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELEKP

SEQ ID NO: 172 - DNA, 1101 bp, Alicyclobacillus acidocaldarius
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 173 - protein, 356 aa, Geobacillus kaustophilus HTA426
TISLCMIVKNEEDVLARCLDSVQHLVDEIVIVDTGSTDRTKEIARSYTARVIDFPWSDDFSAARNFSFSHATMDYIFWLDADDILPAEEQTKFLTLKRTLSSDIDSVTMIYSLAQDEYGKTISSVRRNRLVKRSSGFRWHGMVHEYLEVWGTILNSDITIIHQPNRCASDRNLQIYEKQLAQGKEFSPRDLFYFANELFDHQQYERAIQYYEQFLQTKKGWVEDCIAACGKVADCFDALGDEEQALRYALRSFEYDTPRAECCCRLGYYFLQRKQYRLAAFWYHLATQLTMPSDSWGFVHHACWTWLPHLQLCVCYFYMGEYELAYQHNEKAKQYVPHHPAVLHNECLLQSILAAE

SEQ ID NO: 174 - protein, 347 aa, Desulfitobacterium hafniense Y51
SLCMIVRNEEKTIARCLDSVCDIADEIIIVDTGSTDRTKEIVARYTDKIFDFAWIDDFAAARNYAFSLGTKEYLLWLDADDVILESDRLKFHNLKKNLNPSIDVVNMHYLLAFDSSENPTFTLRRNRLVRRGKNFRWKGAVHEYLEVSGNIMNSDIAIAHKSEEHDSERNLRIYEKRLEQGEEFSPRDLYYFANELYDHKQYEKAVEYYEKFLNTEKGWVEDNISACGKLADIYKLLGDSANAQAYLYKSFDYDTPRAEFCCRIGFNHLNAGKYQQAIFWYKLASELEKPTNSWGPKSEACWTYLPHLQLCVCYDRLGMHELAYKHNEIARDYRPDNPQILHNKKYL

SEQ ID NO: 175 - protein, 355 aa, Clostridium kluyveri DSM 555
KDSITVSLCMIVKNEEDTIGRCLDSVKDVIDEFIIVDTGSSDNTKDVIKKYTDNIYDFEWIDDFSAARNFAFSKATKDYIFWLDADDVLLPEDVEKFKALKKNLDTSIDSVTMRYNVSFDEYSNVTTSYRRNRLVKKEKNFKWIGFVHEYLEVYGNIINSEISVTHKKINYSPNRNLEIFQNKLKEGVEFTPRDILYYGNELYEHRMFEDALKYYNDFLDSKRGWYEDNIHVCGKICDYYQSINNGEECRKYAFKSFEYDSPRAEACCRLGFSFLQENKINQAIFWYETAANLKKPINSLGFFSDACWTWLPHLQLCVCYDRIGKHQLAYEHNEIAGKFRPNDKKILYNRNYFQS

SEQ ID NO: 176 - protein, 351 aa, Clostridium beijerinckii NCIMB 8052
TISLCMIVKNEEDVIANCLESVKDIVDEMIIVDTGSDDKTKKIVKRYTDKIYDFKWIDDFSAARNFAFSKATKDYILWLDADDVVLPEDGEKFKDLKETLDPTVDSVTAKYNTAFDEYGNVTASYRRNRLVKRSNNFQWFGFVHEYLAVGGNIINSEIAITHRKLKQTPKRNLEIYQNKLKEGVVFTPRDILYYGNELYDHRMFDEALQYYNKFLDSKQGWFEDNIRVCEKICDYYQSIDKVEDGRRYAFRSFEYDTPRAEACCKIGFSFLHEKKYKQSAFWYEQATKLEKPKDSWGFFNDACWTWLPHLQLCVCYDRLGDHNLAYEHNEIAAKFRPNDSRILYNRNYFKS

SEQ ID NO: 177 - protein, 345 aa, Bacillus weihenstephanensis KBAB4
TISLCMIVKDEEQTISKCLESVKSVVDEIIIVDTGSTDGTKEIVKKYDAKVYDFQWIEDFSAARNFAFSKATKEYILWLDADDIIDTEDIKKLLQLKHTLDRSTDAVSMKYYLTFDIEGNPTHSLRRYRLVNRSKNFQWYGFVHEYLEVYGNLINSDVGVSHKKEKAYTNRNLKIYEKHLESGKEFSPRDVYYYANECKDHRLFDKAVKGYSRFLDEEKGWVEDNIQACLKRAECYLELGDLKKSIQSCLQSFTYDTPRGELCCHLGRVFLQQGEYSKAIYWYHAAIDGPRPKDSPFVREECHTWLPHIQLCICYDRIKEYEKAIYHNEQAALFIPNNPSIEYNR

SEQ ID NO: 178 - protein, 366 aa, Artificial
  Substituion in SEQ ID NO 171
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDLATKCRRPANFVGFVNHACETWLPHIQLCVCYSRLGNYRKAYDHNERAAEYLGEDPMIVHNRSVLRAWMDGELEKP

SEQ ID NO: 179 - protein, 366 aa, Artificial
  Substituion in SEQ ID NO 171
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRIVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELEKP

SEQ ID NO: 180 - protein, 366 aa, Artificial
  Substituion in SEQ ID NO 171
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDNPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELEKP

SEQ ID NO: 181 - protein, 366 aa, Artificial
  Substituion in SEQ ID NO 171
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSEVDAVTMWYHLAFQGDQPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPEQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELEKP

SEQ ID NO: 182 - protein, 366 aa, Artificial
  Substituion in SEQ ID NO 171
MSAKTENTWSLCMIVKDEEAVLDRCLQSIADIVDEIVIVDTGSQDRTQEIARKYTDLVFDFEWVDDFSEARNESFRHASMDYVLWLDADDVVSDVDRIKLAEFKKNLSSDVDAVTMWYHLAFQGDQPTVSSRLVRLVKRSRGFVWRGRVHEYLEINGNILNSDIAIIHRPVEHDAARNLRIYEKKLALGEDFSPRDMLYYANELLDHAQYEKAVQWYKRFLATGQCWKEDAITACFKLAECFRAMNQPDQSKQAVLHSFLYDTPRAEACCRIGYGYLEEGKIDQAIFWYDLATKCRRPANFVGFVNHACETWLPHIQLCVCYSRLGQYRKAYDHNERAAEYLGEDPMIVHNRSVLRAWMDGELEKP

SEQ ID NO: 183 - DNA, 1101 bp, Artificial
  Substituion in SEQ ID NO 172
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggcaattacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 184 - DNA, 1101 bp, Artificial
  Substituion in SEQ ID NO 172
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtattgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 185 - DNA, 1101 bp, Artificial
  Substituion in SEQ ID NO 172
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgataatccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 186 - DNA, 1101 bp, Artificial
  Substituion in SEQ ID NO 172
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgaagtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggagcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 187 - DNA, 1101 bp, Artificial
  Substituion in SEQ ID NO 172
gtgtccgctaaaacggaaaatacttggagcttatgtatgatcgtgaaagatgaggaggctgtactggatcgctgtctccaatcgattgccgacattgtcgatgaaatcgtgatagttgatacaggttcgcaagacaggacccaagagatcgctcgcaaatacacagatctggtgttcgattttgagtgggtggatgatttcagcgaggcgcgcaacgaatcgttccggcacgccagtatggattacgtcctctggctagacgccgacgacgttgtgtcagatgtagatcgaatcaaactggcagaattcaagaaaaacctttcttccgacgtggacgcagtgacaatgtggtatcacctcgcatttcaaggtgatcagccgaccgtcagttctcgtctcgttcgcctcgtgaaacgatcgcgcggttttgtttggcggggccgcgtccatgaatatcttgaaattaacggcaacatcctcaacagcgacatcgcaatcatccatcgccctgtcgagcatgatgccgctcgcaatcttcgcatctacgagaagaagctcgcgcttggcgaagatttcagcccacgcgacatgctctactacgccaatgagctgctggatcatgcacaatacgagaaggctgtacaatggtacaagcggtttttagcaacaggacaatgttggaaagaggacgccatcacagcttgcttcaagctcgccgaatgctttcgtgcgatgaatcaaccggatcaaagtaagcaagctgtgttacactcgttcctgtacgatacgccgcgagccgaagcgtgttgtcgtatcgggtatggttacttggaagagggaaagatcgatcaggccatcttttggtatgatctagcaaccaaatgcaggcgtccagccaattttgtgggatttgtcaaccatgcatgtgaaacctggttaccccatattcaactttgtgtgtgttatagccggctcggccaatacaggaaagcttatgatcataacgaacgagccgcggagtacctaggtgaagatccgatgatcgtccacaatcgttctgtattgcgagcctggatggatggcgaactcgagaaaccgtaa

SEQ ID NO: 188 - protein, 397 aa, Alicyclobacillus acidocaldarius
MTLEIGYVSTYVPRKCGLATYTHHLRQSVRRAAGPSAADQVIAMLAPDEDVKNYNRSYWFLRRDERRDYARIARRVNDSRIGVVSLQHEFGIFGGEAGSYILDFIDALDKPLVTTFHTVFQKPMSPYREVQKEIAERSDRIVVMNRQAIDYLVDAFGISPSKIHYLPHGTPVRSVTPRAELRKQFGWQDRAVIVTFGLLGPSKGIEFMLDAMPDIVREVPNALYVIAGQTHPEIVKREGEAYRESLMRRIHELHLDDHVVMLNQYMSESDIVDLITAADLYVTPYPNMEQITSGTLAYAVGMGQVVLTTPYAYARDLLKDVPELLVPYGDTRAWADRAVEILTNRDVRAKYAERISAIGADMTWPRVGERHWQLFQDVALRARHRASGVKGFAVIAH

SEQ ID NO: 189 - DNA, 1194 bp, Alicyclobacillus acidocaldarius
atgacgttggaaatcggatatgtcagcacttatgtcccccggaaatgcggacttgccacatatacacaccatttgcgccagagcgttcgccgggcggcgggaccgtccgcggccgaccaggtcatcgccatgttggccccggatgaggacgtgaagaactacaaccgctcgtactggttccttcgccgggatgagcgcagggattacgcgcgcattgcacggcgggtgaacgacagccgaattggcgtggtctccctgcagcacgaattcggcatctttggcggcgaagcagggtcgtacatcctcgacttcattgacgcgctggacaaaccgctcgtgacgacgtttcacaccgtctttcaaaagcccatgtcgccttatcgcgaagtgcagaaggagatcgccgagagaagcgaccgcatcgtcgtgatgaatcgacaggccatcgattatctcgtcgacgcattcggcatctcgccgtcgaagatccactatctcccgcacggcacgccggtgcgatctgtgacgccgcgggccgagttgcggaagcagttcggttggcaagaccgggccgtgatcgtcacctttgggctgctcggtccgagcaagggcattgagttcatgttggatgcgatgccggacatcgtgcgcgaggttccgaacgcgctgtacgtgatcgccggacagacgcacccggaaattgtcaagcgcgagggcgaggcgtaccgcgagtcgctcatgcggcgaatccatgagctccacttggacgatcacgtcgtgatgctgaaccagtacatgtccgagtccgacatcgtggatcttatcacggcggcggatctctacgtcacgccttatccgaacatggagcagattacgagcgggacgctggcctacgcggtcggcatggggcaggtcgtgctgacgacgccgtacgcgtacgcgcgcgaccttctgaaggacgtgccggaactgctcgtgccctacggggacacgcgcgcgtgggcggatcgggctgtggaaatcctgacgaaccgcgatgtgcgcgcgaagtacgcggagcggatttcggcgattggggcagacatgacgtggccgcgcgtgggcgagcgccattggcagttgttccaggacgtcgccctgcgggctcgccatcgcgcatcgggggtgaagggatttgcggtcatcgcacactga

SEQ ID NO: 190 - protein, 394 aa, Geobacillus kaustophilus HTA426
IRIAYVSTYPPRRCGLATFTEHLRQSIDGVRGPSDGDRVIVLYNESDGDDAYRHNPAYWPLPAQNRAAYAEMAKRVNESDIDVVLLQHEFGIFGGEAGEYILDFIAALNKPLVTTFHTVFADPPLPYRPIQEKIAAASDAIIVMNRQAIPYLVKAFGLPEEKIVYIPHGAPGPSSENRDSLRRRLGFSGRKVMLTFGLLSRGKGIESVLAALPGVVRKVPEALYVIAGQTHPEVKKREGEAYREELKSLIHRLGLELHVYMEDRYFSEEELIDYLTACDLYVTPYPGMQQITSGTLAYAVGVGRPVVSTPYEHARDLLQGCEELLLPYGDTTAWEERLGQLLADEAALKRWEEKVRQIGANTHWPRVGEQHVALFARMCDAKRGEVKTIGTVSH

SEQ ID NO: 191 - protein, 393 aa, Geobacillus thermodenitrificans NG80-2
IAYVSTYPPRRCGLATFTEHLRQSIDSVRGKVEGDRVIVLYNEIDGDDAYRGNPAYWPLPAQNRAAYEKMARRVNESDIDVVVLQHEFGIFGGEAGEYILDFIAALQKPLITTFHTVFAAPEPPYRPIQEKIAAASDAIIVMNRQAIGYLVKAFGLPEEKIVYIPHGAPGPSSEERQSLRSRLGFHGRKVMFTFGLLSRGKGIESVLTALPGVVRKVPETLYVIAGQTHPEVKKREGEAYREELKALIHRLGLDDHVRMEDRYFSEEELIDYLTACDLYVTPYPGMQQITSGTLAYAVGVGRPVVSTPYEHARDLLQGCEELLLPYGNTSVWEERLVQLLADEAALERWERIVRQIGANTHWPRVGEQHIALFERVCTAANSGEVKAVDFVSH

SEQ ID NO: 192 - protein, 387 aa, Rhodopirellula baltica SH 1
LKIAFVGDYLPRKCGIATFTHDLRIGVARETCAECIVVTLDDIEGGYAYDNEVQFQVADQELDEYQSAADFLNFSNVDVISLQHEFGIFGGPCGSHILALLQDVRMPVVTTLHTVLSEPNEAQRAVMMQLIRLSTRLVVMTERSRQTLLDTYSVDSDQIDVIAHGIPEAPETDQSVLKEQFGVEDKPVALTFGLLSPGKGIEHVLKAIPEIVAKFPDFIYIILGATHPSLLREQGERYRISLERMAKELGVSKHVSFYNRFVELEELTEFIGAADLYITPYLNVEQAVSGTLAYAFGCGQAVISTPYWHAEELLADGRGVLVPFADPSAIAREVIGLLSDDDRRLAMRDKAYDLGRDMTWEHVSQLYIDSFNRARDQRTSSLKPLAV

SEQ ID NO: 193 - protein, 386 aa, Rhodospirillum rubrum ATCC 11170
IAFIGNSLPRRCGIATFTTHLRQAVGTRFADIETFIVAMTDPGQDYAYPASVPIEVHQDRLEDYLHAADLLNDGNVDIACLQHEFGIFGGEAGENILALLGRLTMPIVTTLHTVLDQPTPAQRDVLDRLFALSAKLIVMAQKARELLRTVYRVPADKIEVIAHGIPDFPFVGSEKAKAELGFSGRAVILTFGLLSPNKGIEVMIDAMPAIVKSRPDAVYVVLGATHPNLVREQGEAYRDSLRARVQDLGLQDHVVFLDRFVDQDTLLRFISMCDIYATPYLNLAQMTSGTLAYSFGLGKPVVSTPYWHARELLADGRGILVPFGDAGAIGLAIAGLLTDDARREAMAERAYIGSRSMIWQRSAERYLDVFTAVLQDRQVHEAAPVE

SEQ ID NO: 194 - protein, 375 aa, Pedobacter sp. BAL39
MKIAYISSYPPRECGIATFNHNLMRAIGHDKSAVSEDSFVVAMNDSDSITTYEYPKEVKYIIRQENQKDYIRAADYINTSLADACILEHEFGIFGGESGVYILPLLARLKKPLITIFHTILKDPSYMQLTIIREIAKYSSRIVVMSHRAVGFLTGIYGIPFAKIQLIEHGVPDLEAKTDNPVRQSLAFKGKKVLFTFGLISRNKGLETVIEALPEIVAQHPDVMYVILGTTHPGVVRNSGEEYRDSLKRLAQKLNVEENLTFINKFVSEGELFDYLTACDMYITPYLNEAQITSGTLSYAVGAGAAVVSTPYWHAQELLADNRGRLFDFKDSHALANNVNELLSDKQKLSELKGNAYEYGLHLRWPSTGQVFVDV

SEQ ID NO: 195 - protein, 397 aa, Artificial
  Substituion in SEQ ID NO 188
MTLEIGYVSTYVPRKCGLATYTHHLRQSVRRAAGPSAADQVIAMLAPDEDVKNYNRSYWFLRRDERRDYARIARRVNDSRIGVVSLQHEFGIFGGEAGSYILDFIDALDKPLVTTFHTVFQKPMSPYREVQKEIAERSDRIVVMNRQAIDYLVDAFGISPSKIHYLPHGTPVRSVTPRAELRKQFGWQDRAVIVTFGLLGPSKGIEFMLDAMPDIVREVPNALYVIAGQTHPEIVKREGEAYRESLMRRIHELHLDDHVVMLNQYMSESDIVDLITAADLYVTPYPNMEQITSGTLAYAVGMGQVVLTTPYAYARDLLKDVPELLVPYGDTRAWADRAVEILTNRDVRAKYAERISAIGADMTWPKVGERHWQLFQDVALRARHRASGVKGFAVIAH

SEQ ID NO: 196 - protein, 397 aa, Artificial
  Substituion in SEQ ID NO 188
MTLEIGYVSTYVPRKCGLATYTHHLRQSVRRAAGPSAADQVIAMLAPDEDVKNYNRSYWFLRRDERRDYARIARRVNDSRIGVVSLQHEFGIFGGEAGSYILDFIDALDKPLVTTFHTVFQKPMSPYREVQKEIAEKSDRIVVMNRQAIDYLVDAFGISPSKIHYLPHGTPVRSVTPRAELRKQFGWQDRAVIVTFGLLGPSKGIEFMLDAMPDIVREVPNALYVIAGQTHPEIVKREGEAYRESLMRRIHELHLDDHVVMLNQYMSESDIVDLITAADLYVTPYPNMEQITSGTLAYAVGMGQVVLTTPYAYARDLLKDVPELLVPYGDTRAWADRAVEILTNRDVRAKYAERISAIGADMTWPRVGERHWQLFQDVALRARHRASGVKGFAVIAH

SEQ ID NO: 197 - protein, 397 aa, Artificial
  Substituion in SEQ ID NO 188
MTLEIGYVSTYVPRKCGLATYTHHLRQSVRRAAGPSAADQVIAMLAPDEDVKNYNRSYWFLRRDERRDYARIARRVNDSRIGVVSLQHEFGIFGGEAGSYILDFIDALDKPLVTTFHTVFQKPMSPYREVQKEIAERSDRIVVMNRQAIDYLVDAFGISPSKIHYLPHGTPVRSVTPRAELRKQFGWQDRAVIVTFGLLGPSKGIEFMLDAMPDIVKEVPNALYVIAGQTHPEIVKREGEAYRESLMRRIHELHLDDHVVMLNQYMSESDIVDLITAADLYVTPYPNMEQITSGTLAYAVGMGQVVLTTPYAYARDLLKDVPELLVPYGDTRAWADRAVEILTNRDVRAKYAERISAIGADMTWPRVGERHWQLFQDVALRARHRASGVKGFAVIAH

SEQ ID NO: 198 - protein, 397 aa, Artificial
  Substituion in SEQ ID NO 188
MTLEIGYVSTYVPRKCGLATYTHHLRQSVRRAAGPSAADQVIAMLAPDEDVKNYNRSYWFLRRDERRDYARIARRVNDSRIGVVSLQHEFGIFGGEAGSYILDFIDALDKPLVTTFHTVFQKPMSPYREVQKEIAERSDRIVVMNRQAIDYLVDAFGISPSKIHYLPHGTPVRSVTPRAELRKQFGWQDRAVIVTFGLLGPSKGIEFMLDAMPDIVREVPNALYVIAGQTHPEIVKREGEAYRESLMRRIHELHLDDHVVMLNQYMSESDIVDLITAADLYVTPYPNMEQITSGTLAYAVGMGQVVLTTPYAYARDLLKDVPELLVPYGDTRAWADRAVEILTNRDVRAKYAERLSAIGADMTWPRVGERHWQLFQDVALRARHRASGVKGFAVIAH

SEQ ID NO: 199 - protein, 397 aa, Artificial
  Substituion in SEQ ID NO 188
MTLEIGYVSTYVPRKCGLATYTHHLRQSVRRAAGPSAADQVIAMLAPDEDVKNYNRSYWFLKRDERRDYARIARRVNDSRIGVVSLQHEFGIFGGEAGSYILDFIDALDKPLVTTFHTVFQKPMSPYREVQKEIAERSDRIVVMNRQAIDYLVDAFGISPSKIHYLPHGTPVRSVTPRAELRKQFGWQDRAVIVTFGLLGPSKGIEFMLDAMPDIVREVPNALYVIAGQTHPEIVKREGEAYRESLMRRIHELHLDDHVVMLNQYMSESDIVDLITAADLYVTPYPNMEQITSGTLAYAVGMGQVVLTTPYAYARDLLKDVPELLVPYGDTRAWADRAVEILTNRDVRAKYAERISAIGADMTWPRVGERHWQLFQDVALRARHRASGVKGFAVIAH

SEQ ID NO: 200 - DNA, 1194 bp, Artificial
  Substituion in SEQ ID NO 189
atgacgttggaaatcggatatgtcagcacttatgtcccccggaaatgcggacttgccacatatacacaccatttgcgccagagcgttcgccgggcggcgggaccgtccgcggccgaccaggtcatcgccatgttggccccggatgaggacgtgaagaactacaaccgctcgtactggttccttcgccgggatgagcgcagggattacgcgcgcattgcacggcgggtgaacgacagccgaattggcgtggtctccctgcagcacgaattcggcatctttggcggcgaagcagggtcgtacatcctcgacttcattgacgcgctggacaaaccgctcgtgacgacgtttcacaccgtctttcaaaagcccatgtcgccttatcgcgaagtgcagaaggagatcgccgagagaagcgaccgcatcgtcgtgatgaatcgacaggccatcgattatctcgtcgacgcattcggcatctcgccgtcgaagatccactatctcccgcacggcacgccggtgcgatctgtgacgccgcgggccgagttgcggaagcagttcggttggcaagaccgggccgtgatcgtcacctttgggctgctcggtccgagcaagggcattgagttcatgttggatgcgatgccggacatcgtgcgcgaggttccgaacgcgctgtacgtgatcgccggacagacgcacccggaaattgtcaagcgcgagggcgaggcgtaccgcgagtcgctcatgcggcgaatccatgagctccacttggacgatcacgtcgtgatgctgaaccagtacatgtccgagtccgacatcgtggatcttatcacggcggcggatctctacgtcacgccttatccgaacatggagcagattacgagcgggacgctggcctacgcggtcggcatggggcaggtcgtgctgacgacgccgtacgcgtacgcgcgcgaccttctgaaggacgtgccggaactgctcgtgccctacggggacacgcgcgcgtgggcggatcgggctgtggaaatcctgacgaaccgcgatgtgcgcgcgaagtacgcggagcggatttcggcgattggggcagacatgacgtggccgaaagtgggcgagcgccattggcagttgttccaggacgtcgccctgcgggctcgccatcgcgcatcgggggtgaagggatttgcggtcatcgcacactga

SEQ ID NO: 201 - DNA, 1194 bp, Artificial
  Substituion in SEQ ID NO 189
atgacgttggaaatcggatatgtcagcacttatgtcccccggaaatgcggacttgccacatatacacaccatttgcgccagagcgttcgccgggcggcgggaccgtccgcggccgaccaggtcatcgccatgttggccccggatgaggacgtgaagaactacaaccgctcgtactggttccttcgccgggatgagcgcagggattacgcgcgcattgcacggcgggtgaacgacagccgaattggcgtggtctccctgcagcacgaattcggcatctttggcggcgaagcagggtcgtacatcctcgacttcattgacgcgctggacaaaccgctcgtgacgacgtttcacaccgtctttcaaaagcccatgtcgccttatcgcgaagtgcagaaggagatcgccgagaaaagcgaccgcatcgtcgtgatgaatcgacaggccatcgattatctcgtcgacgcattcggcatctcgccgtcgaagatccactatctcccgcacggcacgccggtgcgatctgtgacgccgcgggccgagttgcggaagcagttcggttggcaagaccgggccgtgatcgtcacctttgggctgctcggtccgagcaagggcattgagttcatgttggatgcgatgccggacatcgtgcgcgaggttccgaacgcgctgtacgtgatcgccggacagacgcacccggaaattgtcaagcgcgagggcgaggcgtaccgcgagtcgctcatgcggcgaatccatgagctccacttggacgatcacgtcgtgatgctgaaccagtacatgtccgagtccgacatcgtggatcttatcacggcggcggatctctacgtcacgccttatccgaacatggagcagattacgagcgggacgctggcctacgcggtcggcatggggcaggtcgtgctgacgacgccgtacgcgtacgcgcgcgaccttctgaaggacgtgccggaactgctcgtgccctacggggacacgcgcgcgtgggcggatcgggctgtggaaatcctgacgaaccgcgatgtgcgcgcgaagtacgcggagcggatttcggcgattggggcagacatgacgtggccgcgcgtgggcgagcgccattggcagttgttccaggacgtcgccctgcgggctcgccatcgcgcatcgggggtgaagggatttgcggtcatcgcacactga

SEQ ID NO: 202 - DNA, 1194 bp, Artificial
  Substituion in SEQ ID NO 189
atgacgttggaaatcggatatgtcagcacttatgtcccccggaaatgcggacttgccacatatacacaccatttgcgccagagcgttcgccgggcggcgggaccgtccgcggccgaccaggtcatcgccatgttggccccggatgaggacgtgaagaactacaaccgctcgtactggttccttcgccgggatgagcgcagggattacgcgcgcattgcacggcgggtgaacgacagccgaattggcgtggtctccctgcagcacgaattcggcatctttggcggcgaagcagggtcgtacatcctcgacttcattgacgcgctggacaaaccgctcgtgacgacgtttcacaccgtctttcaaaagcccatgtcgccttatcgcgaagtgcagaaggagatcgccgagagaagcgaccgcatcgtcgtgatgaatcgacaggccatcgattatctcgtcgacgcattcggcatctcgccgtcgaagatccactatctcccgcacggcacgccggtgcgatctgtgacgccgcgggccgagttgcggaagcagttcggttggcaagaccgggccgtgatcgtcacctttgggctgctcggtccgagcaagggcattgagttcatgttggatgcgatgccggacatcgtgaaagaggttccgaacgcgctgtacgtgatcgccggacagacgcacccggaaattgtcaagcgcgagggcgaggcgtaccgcgagtcgctcatgcggcgaatccatgagctccacttggacgatcacgtcgtgatgctgaaccagtacatgtccgagtccgacatcgtggatcttatcacggcggcggatctctacgtcacgccttatccgaacatggagcagattacgagcgggacgctggcctacgcggtcggcatggggcaggtcgtgctgacgacgccgtacgcgtacgcgcgcgaccttctgaaggacgtgccggaactgctcgtgccctacggggacacgcgcgcgtgggcggatcgggctgtggaaatcctgacgaaccgcgatgtgcgcgcgaagtacgcggagcggatttcggcgattggggcagacatgacgtggccgcgcgtgggcgagcgccattggcagttgttccaggacgtcgccctgcgggctcgccatcgcgcatcgggggtgaagggatttgcggtcatcgcacactga

SEQ ID NO: 203 - DNA, 1194 bp, Artificial
  Substituion in SEQ ID NO 189
atgacgttggaaatcggatatgtcagcacttatgtcccccggaaatgcggacttgccacatatacacaccatttgcgccagagcgttcgccgggcggcgggaccgtccgcggccgaccaggtcatcgccatgttggccccggatgaggacgtgaagaactacaaccgctcgtactggttccttcgccgggatgagcgcagggattacgcgcgcattgcacggcgggtgaacgacagccgaattggcgtggtctccctgcagcacgaattcggcatctttggcggcgaagcagggtcgtacatcctcgacttcattgacgcgctggacaaaccgctcgtgacgacgtttcacaccgtctttcaaaagcccatgtcgccttatcgcgaagtgcagaaggagatcgccgagagaagcgaccgcatcgtcgtgatgaatcgacaggccatcgattatctcgtcgacgcattcggcatctcgccgtcgaagatccactatctcccgcacggcacgccggtgcgatctgtgacgccgcgggccgagttgcggaagcagttcggttggcaagaccgggccgtgatcgtcacctttgggctgctcggtccgagcaagggcattgagttcatgttggatgcgatgccggacatcgtgcgcgaggttccgaacgcgctgtacgtgatcgccggacagacgcacccggaaattgtcaagcgcgagggcgaggcgtaccgcgagtcgctcatgcggcgaatccatgagctccacttggacgatcacgtcgtgatgctgaaccagtacatgtccgagtccgacatcgtggatcttatcacggcggcggatctctacgtcacgccttatccgaacatggagcagattacgagcgggacgctggcctacgcggtcggcatggggcaggtcgtgctgacgacgccgtacgcgtacgcgcgcgaccttctgaaggacgtgccggaactgctcgtgccctacggggacacgcgcgcgtgggcggatcgggctgtggaaatcctgacgaaccgcgatgtgcgcgcgaagtacgcggagcggttatcggcgattggggcagacatgacgtggccgcgcgtgggcgagcgccattggcagttgttccaggacgtcgccctgcgggctcgccatcgcgcatcgggggtgaagggatttgcggtcatcgcacactga

SEQ ID NO: 204 - DNA, 1194 bp, Artificial
  Substituion in SEQ ID NO 189
atgacgttggaaatcggatatgtcagcacttatgtcccccggaaatgcggacttgccacatatacacaccatttgcgccagagcgttcgccgggcggcgggaccgtccgcggccgaccaggtcatcgccatgttggccccggatgaggacgtgaagaactacaaccgctcgtactggttccttaaacgggatgagcgcagggattacgcgcgcattgcacggcgggtgaacgacagccgaattggcgtggtctccctgcagcacgaattcggcatctttggcggcgaagcagggtcgtacatcctcgacttcattgacgcgctggacaaaccgctcgtgacgacgtttcacaccgtctttcaaaagcccatgtcgccttatcgcgaagtgcagaaggagatcgccgagagaagcgaccgcatcgtcgtgatgaatcgacaggccatcgattatctcgtcgacgcattcggcatctcgccgtcgaagatccactatctcccgcacggcacgccggtgcgatctgtgacgccgcgggccgagttgcggaagcagttcggttggcaagaccgggccgtgatcgtcacctttgggctgctcggtccgagcaagggcattgagttcatgttggatgcgatgccggacatcgtgcgcgaggttccgaacgcgctgtacgtgatcgccggacagacgcacccggaaattgtcaagcgcgagggcgaggcgtaccgcgagtcgctcatgcggcgaatccatgagctccacttggacgatcacgtcgtgatgctgaaccagtacatgtccgagtccgacatcgtggatcttatcacggcggcggatctctacgtcacgccttatccgaacatggagcagattacgagcgggacgctggcctacgcggtcggcatggggcaggtcgtgctgacgacgccgtacgcgtacgcgcgcgaccttctgaaggacgtgccggaactgctcgtgccctacggggacacgcgcgcgtgggcggatcgggctgtggaaatcctgacgaaccgcgatgtgcgcgcgaagtacgcggagcggatttcggcgattggggcagacatgacgtggccgcgcgtgggcgagcgccattggcagttgttccaggacgtcgccctgcgggctcgccatcgcgcatcgggggtgaagggatttgcggtcatcgcacactga

SEQ ID NO: 205 - protein, 404 aa, Alicyclobacillus acidocaldarius
MRSSHTDGLPVSLDHLRRMTDDTGLIEHAIGRIPRRQEGYSTDDNARALWLAYEWLHYARERGLEAEAADLARLIDIYFAFLAWVQKPDGWFHNNVSYDRRFELEVPSDDCQGRSVYALAVGMCEERDPARLTAYAQVLRRGLEAALRLTHARGVAHVVAAAARLLRHAEGVELPEDAAPEFWAFVRQRLPGVVERGARDLVSRFEAHARGDWPWFEDRMTYDNAVMPWALFEAYALTGEARWREVAEASLDGLLARMRAPEGWLRPIGNRGFAAPGFTAIWDQQPLEIAQLAIACESAWRATGDTAYRRLTAECQRWFYGENDKGVPMADPADGSCCDGLTPQGPNLNRGAESTWSYLITEIHVERAFADDLDAARAFGAWVGVPRQTLVSARSRRALGGFHR

SEQ ID NO: 206 - DNA, 1215 bp, Alicyclobacillus acidocaldarius
ttgcggtcatcgcacactgatgggctgccggtttcgctggatcacctgcgccggatgacagacgacacagggctcattgaacacgcgattggccgcattcctcgccgtcaggaagggtattccaccgacgacaacgcgcgggcgctctggctcgcgtacgagtggctccactacgcccgcgagcggggcctggaggcggaggcggccgatctcgcgcggctcatcgacatctacttcgcgtttttggcctgggtccagaagcccgacggctggttccacaacaacgtgtcgtacgatcgccgctttgagctggaggttccgtcggacgactgccaagggaggtccgtgtacgcgctggcggtgggcatgtgcgaggagcgcgatccggcccgcctgacggcctacgcgcaagtgcttcgccggggccttgaggcagcccttaggctcacgcacgcacgcggcgtcgcccatgtcgtagcggccgccgcaaggcttttgcgccacgcagagggggtcgagcttcccgaagacgcggcgcccgagttctgggcctttgtccgtcagcgcctgccgggcgtcgtggagcgcggcgctcgcgatctcgtgtcgcggttcgaggcgcacgcacgcggcgactggccttggttcgaggaccgcatgacgtacgacaacgcggtcatgccctgggcgctcttcgaagcctatgcgctcaccggcgaggcccgatggagagaagtcgcggaagcctcgctcgacgggcttctcgcccgcatgcgtgcgcccgagggatggcttcggcccattggcaaccgcggcttcgcggcgcctggcttcaccgccatttgggaccagcagccgctggaaatcgcccagctcgccattgcgtgcgaatcggcctggcgcgcgacgggtgacacggcctatcggcggcttacggccgagtgccagcgctggttctacggtgaaaacgacaaaggggtgccgatggccgatccggccgacggcagttgctgcgacggcctgacgccgcagggtcccaacctgaaccgcggtgcagagtcgacgtggtcgtacctcatcaccgagatccacgtcgagcgggcatttgccgatgatctggacgccgcgcgggcgttcggcgcgtgggtgggcgttccgcgccagaccctcgtgtccgcacggtcgagacgggcgctcggcggctttcaccggtga

SEQ ID NO: 207 - protein, 337 aa, Geobacillus kaustophilus HTA426
IKFDHLERMTDDTGLLEHSLGRIPRRREGYSTDDNARAIWACLEWMALCEDKGEKERLHRLLDRYLAFLLWAQNDDGTFHNNFFFDRTKEEETPSDDCFGRSFWATALAYVRLSDPARREAAADMLRRAMPAAWELRSLRGVAWGVATCGVLLTEGRPLGVDQEEVAALAARLEQRLLAAYWEHAGDDWYWYEPELTYANGVLPWALWTAYRRAPRDEVKEVAEKSLAFLIEKMSGPGGVIRPVGNRGWCSRRYRADWDQQPLDVMKLALAAREAYWATDDERYRGVVRRCLAWFYGQNDGNAPLADPSDGSCCDGLGPNGPNPNRGAESTLSYLLT

SEQ ID NO: 208 - protein, 329 aa, Geobacillus thermodenitrificans NG80-2
MTDDTGLLEHSLGRIPRRREGYSTDDNARAIWACLEWLALLKNREMEKRLYRLLDRYLAFLLWAQNDDGTFHNNFFFDRTKEEETPSDDCLGRSFWAVASAYIQLNDPARCEAAADMLRRGMPAAWKLHSLRGIAWGLAACGLLLEKASPPGVDKEELATLAGRFERRLLEAYWTHTDDGWRWYEPELTYGNGVLPWALWTAYRRAPRQEVREVAEESLAFLIEMMSGPEGTIRPVGNRGWCSRRYRADWDQQPIDVMKLALAAREAYWATEDERYRDVVRRCLAWFYGKNDGNVPLADRSDGSCCDGLGPNGPNPNRGAESTLSYLLT

SEQ ID NO: 209 - protein, 339 aa, Symbiobacterium thermophilum IAM 14863
LSHLQRLTDPTGVIQHAVGPIPNLTTGYTSDDNARALLVSVWAARAGEATAQLSETYLAFLAYAQRPDGWFHNAFSYDRNPLAEDRSEDCQARCLWGLAAAATQLGGSSVAWTAAHLFRRGLAPCGSVRTLRGRAGVAVAMAEWLEHRRADGRPDGAPTDDEVRAHLIRAADGLTDAWKQHATRDWAWFEDRLTYDNALLPYALLRAGRILDVPEYRRIGLTALEFLAGATFRDGVFWPIGNDGWYVRGGRRAEFDQQPLEATAMVLACQEAGAVTGDKVWHGMALDAARWFTGRNALGVPLLDPETGGCHDGLNPHGVNRNQGAESTLAWLMAAYGLE

SEQ ID NO: 210 - protein, 322 aa, Clostridium thermocellum ATCC 27405
DHIFRMTDDTGMLQHSKYSLPDPNHGYTTDDNARALIMALMLYKKYGEKKYLDLVYRYSSFLLNAQNEKGKFKNFMGYDRKWLEDEGSEDCFGRCLWAIGFALSGDFTPRGVKHALLEIFNKAMPHAANLSYLRGKAYSAIGLSFFDGDDSKELVFSIAQSLCCQYDEHKDGEWKWFEDVVSYCNSVLPWSLLTAYKVTGEKRFLETAEESLDFLGKITFKDGYFKPVGCNGWFKKGKEQAEFDEQPVEACEAVLTYLEAFELTGKTKYLEKAKICNAWYSGMNSKGIPLVDPETGGCYDGLTQKGVNLNMGAESLVSYIIS

SEQ ID NO: 211 - protein, 333 aa, Thermoanaerobacter tengcongensis MB4
HLFTLTDDTGIFQHSLYSIPDPSKGYTTDDNARAAIAATMLYQVYREEVYLSLLRRYLSFLIYAQNEEGFFRNFMNYNREFTEKKGSEDCFGRSLWALGYLLNVPFSDESYHNVAIRLLEKALFNVKKLYSLRGKAYSLIGLSLIYNSEAFEFDRGEIRDLVKSLSQDLLKSYYKNREENWKWFEDQMTYSNAILPWSLLKAYTVTKDEEVLRVAKESMDFLGSVTFKDGYFKPIGCKGWYKKGGKRAEFDEQPIEACESALMYIEAYRVFGEEEYLNKAKKCYRWFLGENSQNISLVDEETGGCYDGITEDGVNLNEGAESLISLIMTDMVV

SEQ ID NO: 212 - protein, 404 aa, Artificial
  Substituion in SEQ ID NO 205
MRSSHTDGLPVSLDHLRRMTDDTGLIEHAIGRIPRRQEGYSTDDNARALWLAYEWLHYARERGLEAEAADLARLIDIYFAFLAWVQKPDGWFHNNVSYDRRFELEVPSDDCQGRSVYALAVGMCEERDPARLTAYAQVLRRGLEAALRLTHARGVAHVVAAAARLLRHAEGVELPEDAAPEFWAFVRQRLPGVVERGARDLVSRFEAHARGDWPWFEDRMTYDNAVMPWALFEAYALTGEARWREVAEASLDGLLARMRAPEGWLRPIGNRGFAAPGFTAIWDQQPLEIAQLAIACESAWRATGDTAYRRLTAECQRWFYGENDKGVPMADPADGSCCDGLTPQGPNLNRGAESTWSYLITEIHVERAFAEDLDAARAFGAWVGVPRQTLVSARSRRALGGFHR

SEQ ID NO: 213 - protein, 404 aa, Artificial
  Substituion in SEQ ID NO 205
MRSSHTDGLPVSLDHLRRMTDDTGLIEHAIGRIPRRQEGYSTDDNARALWLAYEWLHYARERGLEAEAADLARLIDIYFAFLAWVQKPDGWFHNNVSYDRRFELEVPSDDCQGRSVYALAVGMCEERDPARLTAYAQVLRRGLEAALRLTHARGVAHVVAAAARLLRHAEGVELPEDAAPEFWAFVRQRLPGVVERGARDLVSRFEAHARGDWPWFEDRMTYDNAVMPWALFEAYALTGEARWREVAEASLDGLLARMRAPEGWLRPIGNRGFAAPGFTAIWDQQPLEIAQLAIACESAWRATGDTAYRRLTAECQRWFYGENDKGVPMADPADGSCCDGLTPQGPNLNRGAESTWSYLITEIHVERAFADDIDAARAFGAWVGVPRQTLVSARSRRALGGFHR

SEQ ID NO: 214 - protein, 404 aa, Artificial
  Substituion in SEQ ID NO 205
MRSSHTDGLPVSLDHLRRMTDDTGLIEHAIGRIPRRQEGYSTDDNARALWLAYEWLHYARERGLEAEAADLARLIDIYFAFLAWVQKPDGWFHNNVSYDRRFELEVPSDDCQGRSVYALAVGMCEERDPARLTAYAQVLRRGLEAALRLTHARGVAHVVAAAARLLRHAEGVELPEDAAPEFWAFVRQRLPGVVERGARDLVSRFEAHARGDWPWFEDRMTYDNAVMPWALFEAYALTGEARWREVAEASLDGLLARMKAPEGWLRPIGNRGFAAPGFTAIWDQQPLEIAQLAIACESAWRATGDTAYRRLTAECQRWFYGENDKGVPMADPADGSCCDGLTPQGPNLNRGAESTWSYLITEIHVERAFADDLDAARAFGAWVGVPRQTLVSARSRRALGGFHR

SEQ ID NO: 215 - protein, 404 aa, Artificial
  Substituion in SEQ ID NO 205
MRSSHTDGLPVSLDHLRRMTDDTGLIEHAIGRIPRRQEGYSTDDNARALWLAYEWLHYARERGLEAEAADLARLIDIYFAFLAWVQKPDGWFHNNVSYDRRFELEVPSDDCQGRSVYALAVGMCEERDPARLTAYAQVLRRGLEAALRLTHARGVAHVVAAAARLLRHAEGVELPEDAAPEFWAFVRQRLPGVVERGARDLVSRFEAHARGDWPWFEDRMTYENAVMPWALFEAYALTGEARWREVAEASLDGLLARMRAPEGWLRPIGNRGFAAPGFTAIWDQQPLEIAQLAIACESAWRATGDTAYRRLTAECQRWFYGENDKGVPMADPADGSCCDGLTPQGPNLNRGAESTWSYLITEIHVERAFADDLDAARAFGAWVGVPRQTLVSARSRRALGGFHR

SEQ ID NO: 216 - protein, 404 aa, Artificial
  Substituion in SEQ ID NO 205
MRSSHTDGLPVSLDHLRRMTDDTGLIEHAIGRIPRRQEGYSTDDNARALWLAYEWLHYARERGLEAEAADLARLIDIYFAFLAWVQKPDGWFHNNVSYDRRFELEVPSDDCQGRSVYALAVGMCEERDPARLTAYAQVLRRGLDAALRLTHARGVAHVVAAAARLLRHAEGVELPEDAAPEFWAFVRQRLPGVVERGARDLVSRFEAHARGDWPWFEDRMTYDNAVMPWALFEAYALTGEARWREVAEASLDGLLARMRAPEGWLRPIGNRGFAAPGFTAIWDQQPLEIAQLAIACESAWRATGDTAYRRLTAECQRWFYGENDKGVPMADPADGSCCDGLTPQGPNLNRGAESTWSYLITEIHVERAFADDLDAARAFGAWVGVPRQTLVSARSRRALGGFHR

SEQ ID NO: 217 - DNA, 1215 bp, Artificial
  Substituion in SEQ ID NO 206
ttgcggtcatcgcacactgatgggctgccggtttcgctggatcacctgcgccggatgacagacgacacagggctcattgaacacgcgattggccgcattcctcgccgtcaggaagggtattccaccgacgacaacgcgcgggcgctctggctcgcgtacgagtggctccactacgcccgcgagcggggcctggaggcggaggcggccgatctcgcgcggctcatcgacatctacttcgcgtttttggcctgggtccagaagcccgacggctggttccacaacaacgtgtcgtacgatcgccgctttgagctggaggttccgtcggacgactgccaagggaggtccgtgtacgcgctggcggtgggcatgtgcgaggagcgcgatccggcccgcctgacggcctacgcgcaagtgcttcgccggggccttgaggcagcccttaggctcacgcacgcacgcggcgtcgcccatgtcgtagcggccgccgcaaggcttttgcgccacgcagagggggtcgagcttcccgaagacgcggcgcccgagttctgggcctttgtccgtcagcgcctgccgggcgtcgtggagcgcggcgctcgcgatctcgtgtcgcggttcgaggcgcacgcacgcggcgactggccttggttcgaggaccgcatgacgtacgacaacgcggtcatgccctgggcgctcttcgaagcctatgcgctcaccggcgaggcccgatggagagaagtcgcggaagcctcgctcgacgggcttctcgcccgcatgcgtgcgcccgagggatggcttcggcccattggcaaccgcggcttcgcggcgcctggcttcaccgccatttgggaccagcagccgctggaaatcgcccagctcgccattgcgtgcgaatcggcctggcgcgcgacgggtgacacggcctatcggcggcttacggccgagtgccagcgctggttctacggtgaaaacgacaaaggggtgccgatggccgatccggccgacggcagttgctgcgacggcctgacgccgcagggtcccaacctgaaccgcggtgcagagtcgacgtggtcgtacctcatcaccgagatccacgtcgagcgggcatttgccgaagatctggacgccgcgcgggcgttcggcgcgtgggtgggcgttccgcgccagaccctcgtgtccgcacggtcgagacgggcgctcggcggctttcaccggtga

SEQ ID NO: 218 - DNA, 1215 bp, Artificial
  Substituion in SEQ ID NO 206
ttgcggtcatcgcacactgatgggctgccggtttcgctggatcacctgcgccggatgacagacgacacagggctcattgaacacgcgattggccgcattcctcgccgtcaggaagggtattccaccgacgacaacgcgcgggcgctctggctcgcgtacgagtggctccactacgcccgcgagcggggcctggaggcggaggcggccgatctcgcgcggctcatcgacatctacttcgcgtttttggcctgggtccagaagcccgacggctggttccacaacaacgtgtcgtacgatcgccgctttgagctggaggttccgtcggacgactgccaagggaggtccgtgtacgcgctggcggtgggcatgtgcgaggagcgcgatccggcccgcctgacggcctacgcgcaagtgcttcgccggggccttgaggcagcccttaggctcacgcacgcacgcggcgtcgcccatgtcgtagcggccgccgcaaggcttttgcgccacgcagagggggtcgagcttcccgaagacgcggcgcccgagttctgggcctttgtccgtcagcgcctgccgggcgtcgtggagcgcggcgctcgcgatctcgtgtcgcggttcgaggcgcacgcacgcggcgactggccttggttcgaggaccgcatgacgtacgacaacgcggtcatgccctgggcgctcttcgaagcctatgcgctcaccggcgaggcccgatggagagaagtcgcggaagcctcgctcgacgggcttctcgcccgcatgcgtgcgcccgagggatggcttcggcccattggcaaccgcggcttcgcggcgcctggcttcaccgccatttgggaccagcagccgctggaaatcgcccagctcgccattgcgtgcgaatcggcctggcgcgcgacgggtgacacggcctatcggcggcttacggccgagtgccagcgctggttctacggtgaaaacgacaaaggggtgccgatggccgatccggccgacggcagttgctgcgacggcctgacgccgcagggtcccaacctgaaccgcggtgcagagtcgacgtggtcgtacctcatcaccgagatccacgtcgagcgggcatttgccgatgatattgacgccgcgcgggcgttcggcgcgtgggtgggcgttccgcgccagaccctcgtgtccgcacggtcgagacgggcgctcggcggctttcaccggtga

SEQ ID NO: 219 - DNA, 1215 bp, Artificial
  Substituion in SEQ ID NO 206
ttgcggtcatcgcacactgatgggctgccggtttcgctggatcacctgcgccggatgacagacgacacagggctcattgaacacgcgattggccgcattcctcgccgtcaggaagggtattccaccgacgacaacgcgcgggcgctctggctcgcgtacgagtggctccactacgcccgcgagcggggcctggaggcggaggcggccgatctcgcgcggctcatcgacatctacttcgcgtttttggcctgggtccagaagcccgacggctggttccacaacaacgtgtcgtacgatcgccgctttgagctggaggttccgtcggacgactgccaagggaggtccgtgtacgcgctggcggtgggcatgtgcgaggagcgcgatccggcccgcctgacggcctacgcgcaagtgcttcgccggggccttgaggcagcccttaggctcacgcacgcacgcggcgtcgcccatgtcgtagcggccgccgcaaggcttttgcgccacgcagagggggtcgagcttcccgaagacgcggcgcccgagttctgggcctttgtccgtcagcgcctgccgggcgtcgtggagcgcggcgctcgcgatctcgtgtcgcggttcgaggcgcacgcacgcggcgactggccttggttcgaggaccgcatgacgtacgacaacgcggtcatgccctgggcgctcttcgaagcctatgcgctcaccggcgaggcccgatggagagaagtcgcggaagcctcgctcgacgggcttctcgcccgcatgaaagcgcccgagggatggcttcggcccattggcaaccgcggcttcgcggcgcctggcttcaccgccatttgggaccagcagccgctggaaatcgcccagctcgccattgcgtgcgaatcggcctggcgcgcgacgggtgacacggcctatcggcggcttacggccgagtgccagcgctggttctacggtgaaaacgacaaaggggtgccgatggccgatccggccgacggcagttgctgcgacggcctgacgccgcagggtcccaacctgaaccgcggtgcagagtcgacgtggtcgtacctcatcaccgagatccacgtcgagcgggcatttgccgatgatctggacgccgcgcgggcgttcggcgcgtgggtgggcgttccgcgccagaccctcgtgtccgcacggtcgagacgggcgctcggcggctttcaccggtga

SEQ ID NO: 220 - DNA, 1215 bp, Artificial
  Substituion in SEQ ID NO 206
ttgcggtcatcgcacactgatgggctgccggtttcgctggatcacctgcgccggatgacagacgacacagggctcattgaacacgcgattggccgcattcctcgccgtcaggaagggtattccaccgacgacaacgcgcgggcgctctggctcgcgtacgagtggctccactacgcccgcgagcggggcctggaggcggaggcggccgatctcgcgcggctcatcgacatctacttcgcgtttttggcctgggtccagaagcccgacggctggttccacaacaacgtgtcgtacgatcgccgctttgagctggaggttccgtcggacgactgccaagggaggtccgtgtacgcgctggcggtgggcatgtgcgaggagcgcgatccggcccgcctgacggcctacgcgcaagtgcttcgccggggccttgaggcagcccttaggctcacgcacgcacgcggcgtcgcccatgtcgtagcggccgccgcaaggcttttgcgccacgcagagggggtcgagcttcccgaagacgcggcgcccgagttctgggcctttgtccgtcagcgcctgccgggcgtcgtggagcgcggcgctcgcgatctcgtgtcgcggttcgaggcgcacgcacgcggcgactggccttggttcgaggaccgcatgacgtacgaaaacgcggtcatgccctgggcgctcttcgaagcctatgcgctcaccggcgaggcccgatggagagaagtcgcggaagcctcgctcgacgggcttctcgcccgcatgcgtgcgcccgagggatggcttcggcccattggcaaccgcggcttcgcggcgcctggcttcaccgccatttgggaccagcagccgctggaaatcgcccagctcgccattgcgtgcgaatcggcctggcgcgcgacgggtgacacggcctatcggcggcttacggccgagtgccagcgctggttctacggtgaaaacgacaaaggggtgccgatggccgatccggccgacggcagttgctgcgacggcctgacgccgcagggtcccaacctgaaccgcggtgcagagtcgacgtggtcgtacctcatcaccgagatccacgtcgagcgggcatttgccgatgatctggacgccgcgcgggcgttcggcgcgtgggtgggcgttccgcgccagaccctcgtgtccgcacggtcgagacgggcgctcggcggctttcaccggtga

SEQ ID NO: 221 - DNA, 1215 bp, Artificial
  Substituion in SEQ ID NO 206
ttgcggtcatcgcacactgatgggctgccggtttcgctggatcacctgcgccggatgacagacgacacagggctcattgaacacgcgattggccgcattcctcgccgtcaggaagggtattccaccgacgacaacgcgcgggcgctctggctcgcgtacgagtggctccactacgcccgcgagcggggcctggaggcggaggcggccgatctcgcgcggctcatcgacatctacttcgcgtttttggcctgggtccagaagcccgacggctggttccacaacaacgtgtcgtacgatcgccgctttgagctggaggttccgtcggacgactgccaagggaggtccgtgtacgcgctggcggtgggcatgtgcgaggagcgcgatccggcccgcctgacggcctacgcgcaagtgcttcgccggggccttgatgcagcccttaggctcacgcacgcacgcggcgtcgcccatgtcgtagcggccgccgcaaggcttttgcgccacgcagagggggtcgagcttcccgaagacgcggcgcccgagttctgggcctttgtccgtcagcgcctgccgggcgtcgtggagcgcggcgctcgcgatctcgtgtcgcggttcgaggcgcacgcacgcggcgactggccttggttcgaggaccgcatgacgtacgacaacgcggtcatgccctgggcgctcttcgaagcctatgcgctcaccggcgaggcccgatggagagaagtcgcggaagcctcgctcgacgggcttctcgcccgcatgcgtgcgcccgagggatggcttcggcccattggcaaccgcggcttcgcggcgcctggcttcaccgccatttgggaccagcagccgctggaaatcgcccagctcgccattgcgtgcgaatcggcctggcgcgcgacgggtgacacggcctatcggcggcttacggccgagtgccagcgctggttctacggtgaaaacgacaaaggggtgccgatggccgatccggccgacggcagttgctgcgacggcctgacgccgcagggtcccaacctgaaccgcggtgcagagtcgacgtggtcgtacctcatcaccgagatccacgtcgagcgggcatttgccgatgatctggacgccgcgcgggcgttcggcgcgtgggtgggcgttccgcgccagaccctcgtgtccgcacggtcgagacgggcgctcggcggctttcaccggtga

SEQ ID NO: 222 - protein, 417 aa, Alicyclobacillus acidocaldarius
MTLMYLLWDTFYDALKLVTGLVALYQIVLSVYGIWHRRRPITHAPQKRFAIIIPAHNEECVIGPLLDSLKRQTYPAHLYDVHVIADNCTDGTAERARAHGAIVHVRENRAEQGKGYAIEWMLARLKEMGARYDAIVMFDADNLVHPDFLAIMNDHLCSGDRVIQGYLDTKNPFDSWISVSLAISYWFDNRLWQYARARLHLPCTLGGTGLCIDYPLLQEMGWKATGLTEDLEFGIRCVRRGIIPVWAHDARVYDEKPTSFAASFRQRLRWQQGHFQCAREHLVPMFLEGLRERNLAKIDMAIYLFQPMRSMLLFAGAMIVLGLHYLSPDPTDAASNPAALMVTNLWVAVNVILFLEVPLALLLERVNWRAYFALPLLPFFLWTWGPVTLQAYFTRSNRTWYHTVHKRAIRLDELRER

SEQ ID NO: 223 - DNA, 1254 bp, Alicyclobacillus acidocaldarius
atgacattgatgtacttgctctgggacacgttctatgacgcgctgaagctcgtcacgggccttgtggcgctgtaccagattgtgctgtccgtgtacggcatctggcaccgcagacggcccatcacgcatgcgccgcagaagcgcttcgccatcatcattccggcgcacaacgaggagtgcgtgatcggcccgctcctcgacagcctgaagcgccagacgtatcccgcgcacctgtacgacgtgcatgtcatcgcggacaactgcacggacggcaccgcggagcgcgcgcgggcgcacggcgccattgtccacgtgcgcgaaaaccgcgcggaacagggcaaggggtacgccatcgaatggatgctggcgcgcctgaaggaaatgggcgctcgatacgacgccatcgtgatgttcgacgcggataatttggttcatccggactttctcgccatcatgaacgaccacctgtgcagcggcgatcgcgtcattcagggatatctggataccaagaatccattcgattcgtggatcagcgtgtcgctcgccatctcctattggttcgacaatcggctgtggcagtacgcccgcgcccgcctgcatctgccgtgtacgctcggtgggaccggcctttgcatcgattatccgctgttgcaggagatgggatggaaggcgacgggcctcaccgaggatctcgagttcgggattcgctgcgtccgccgaggaattatccccgtctgggcgcacgacgcgcgcgtctacgacgagaagccgacgagcttcgcggcgtctttccgccagcgcctgcgctggcagcaggggcatttccaatgtgcacgtgaacacttggtccccatgtttctcgaggggctgcgcgagcggaacttggccaaaatcgacatggccatttacctgtttcagcccatgcggtccatgctgctgtttgcgggcgccatgattgtgctcggccttcactacctgtcgcccgatccgaccgatgcagcgtccaacccggccgcgctcatggtcacgaatctgtgggtcgcggtgaacgtgatcctgtttctcgaggttcccctcgcgctgctgctcgaacgggtgaactggcgggcgtattttgccctgcccctccttccgttctttctctggacctggggccccgtgacgctgcaggcctacttcacgcgcagcaaccggacgtggtaccacacggtgcacaagcgcgccattcgcttggatgagctgcgcgagcggtaa

SEQ ID NO: 224 - protein, 402 aa, Clostridium thermocellum ATCC 27405
MQVVIFIAGCYFFGISIFGWIKRRETSPKEYVPQKKFALIVAAHNEEAVIGHIVDSLFRQNYPRNLFDVYVVADNCTDRTAEIAEEHGAIVYKRYNNSARGKGYALEWMFEKIYNMEEKYDAISVFDADNLVSANYLLEMNKQLCKGHKVVQGYVDSKNPFDSWITLSYSIAFWLSNRIFQLPRYYLGLSCGLCGTGFCISVDVLKEIGWGATCLTEDLEFTMKLALNNYKVAWAHNAVVYDEKPITLKQSWNQRKRWMQGHADCASRYLGPLFKKAFREGDLIAFDCAVYLFQPIRLVFIGLITIMMWIQTVFPESPFYNLKYVFPTEVWSVFVTLQFLYGPLVVLSEKKFNLKVLYGFLIYPFYCITWIPITIQGFMSKNNKDWSHTQHSRKISISDLEK

SEQ ID NO: 225 - protein, 407 aa, Thermosinus carboxydivorans Nor1
MNYIFDYIMIPMQLIIIFFTLYYFIIAIFGIWRRKEEKITTPEKSFAIIIAAHNEEQVIGQLVENLQVLRYPRELYDIFVVADNCKDRTAQIARNAGAIVYERFNLEQRGKGYAMEWMFAKLFRMKRKYDAVVVFDADNLVHPNFLLEMNNRLCKGEKVIQGYLDAKNPHDTWIAGTFAISFWVVNHIWHLAKYNIGLSSVLGGTGMCIATDVLQKFGWGATCLTEDMEFTMKVLLKGIRTTWAHDAIVYDEKPLTFKQSWYQRKRWAQGHFDVAGRYIPRLLYEGFKRRDIRILDGVLHLLQPHFLILSTIFVLLSYIYHIVPFYTNILYMVLPVEVWTVIAIGQYVFPIIVLAKIRAHWKSWLYLIFYPIFVYSWIPITFMGYLHRNDREWSHTQHTRGLSYHDI

SEQ ID NO: 226 - protein, 400 aa, Clostridium cellulolyticum H10
IQILIFIAGCYFFGISIFGWVKRRQKSPQNIIPTKRFALVVAAHNEELVIGHIVDSLFKLNYPKNLYDVFVIADNCTDNTAGIARRFGAKVHIREDASKKGKGHALEWMFHRIFHMDTSYDAIAVFDADNLVSQNFLLEMNKQMCKGFKVVQGYIDSKNPYDSWITCSYSIAFWLSNRIYQLPRYYLKLSCGLCGTGFCIDTSILKTLKWGATCLTEDLEYTMKMALNGVKIGWAHEAVVYDEKPITLKQSWHQRKRWMQGHAECAQKYLGALFKKALFKGDLTSLDCALYLFQPIRFIFVGLMTVMMWVQTVYPQFPLYSVQYVFPVQVWYLMGLFEMFYGPLVILAEKKFSLKVILGFIIYPYYCLTWIPITIQGILEKNNKEWNHTVHTRQISINEL

SEQ ID NO: 227 - protein, 395 aa, Pelotomaculum thermopropionicum SI
EAIFYATQVFLTLFTFYHFIISLYGFYRRHEECLLPPSSRFAIVVAAHNEEKVIGELIRNLNELDYPKELYDVYVVADNCTDSTAKIAREKGAVVFERFNKAERGKPYALEFAFSKIFESGIPYDAVCVFDADNLVDTNFLTVMNAHLLKGEKIIQGYLDTKNAGDTWITKSIYVSYILTNRFLQLSKYNLGLTCALGGTGMCLSVDVLKRYGWGMTSLTEDLEFQTKALLNGIKVTWAHDARVYDEKPLTLMQSWRQRKRWMQGHTNVAGRYVARLVREGIRTRNFAMIDGAVYLIQPYFLMFTGIGLITNIFMGPDQILDRPVWLVVGFFAQFFYFGLGLALERVKPVVYWWLIFYPIFALTWIPVAYVGFAMRKNKEWTHTLHFRNIKHENL

SEQ ID NO: 228 - protein, 397 aa, Desulfitobacterium hafniense Y51
VQLIIIFMTFYYFVLSMFGLFRRPDKKVLEPEKSFALVVAAHNEEAVIGPLVDNLLNLDYPKELYDVFVVADNCTDKTALIAKNAGALVHQRFNNEKRGKGYALEWMFHRLFKLERHYDAVIIFDADNLVNETFLVEMNSKLCQGHQIVQCYLDSKNPYDTWVTNTFSITFWLSNRLLQLARYNTGFLNNVLGGTGMCISTKVLKDLGWGATSLTEDLEFTMKALISGIKTTWAHDAIVYDEKPLTFIQAWNQRKRWAQGQVDVAGRYFFPLIYKAFKERKLMYFDAAVHLFQPALVMIATFFMFVNLISGLQSSYTQVFNVVMPWSGWQILSAFSLVFPVAALALERLPWRAYAGLILYPVFIYSWIPIVFLGFVNRKDKSWSHTKHTRSIKYDDV

SEQ ID NO: 229 - protein, 417 aa, Artificial
  Substituion in SEQ ID NO 222
MTLMYLLWDTFYDALKLVTGLVALYQIVLSVYGIWHRRRPITHAPQKRFAIIIPAHNEECVIGPLLDSLKRQTYPAHLYDVHVIADNCTDGTAERARAHGAIVHVRENRAEQGKGYAIEWMLARLKEMGARYDAIVMFDADNLVHPDFLAIMNDHLCSGDRVIQGYLDTKNPFDSWISVSLAISYWFDNRLWQYARARLHLPCTLGGTGLCIDYPLLQEMGWKATGLTEDLEFGIRCVRRGIIPVWAHDARVYDEKPTSFAASFRQRLRWQQGHFQCAREHLVPMFLEGLRERNLAKIDMAIYLFQPMRSMLLFAGAMIVLGLHYLSPDPTDAASNPAALMVTNLWVAVNVILFLEVPLALLLERINWRAYFALPLLPFFLWTWGPVTLQAYFTRSNRTWYHTVHKRAIRLDELRER

SEQ ID NO: 230 - protein, 417 aa, Artificial
  Substituion in SEQ ID NO 222
MTLMYLLWDTFYDALKLVTGLVALYQIVLSVYGIWHRRRPITHAPQKRFAIIIPAHNEECVIGPLLDSLKRQTYPAHLYDVHVIADNCTDGTAERARAHGAIVHVRENRAEQGKGYAIEWMLARLKEMGARYDAIVMFDADNLVHPDFLAIMNDHLCSGDRVIQGYLDTKNPFDSWISVSLAISYWFDNRLWQYARARLHLPCTLGGTGLCIDYPLLQEMGWKATGLTEDLEFGIRCVRRGIIPVWAHDARVYDEKPTSFAASFRQRLRWQQGHFQCAREHLVPMFLEGLRDRNLAKIDMAIYLFQPMRSMLLFAGAMIVLGLHYLSPDPTDAASNPAALMVTNLWVAVNVILFLEVPLALLLERVNWRAYFALPLLPFFLWTWGPVTLQAYFTRSNRTWYHTVHKRAIRLDELRER

SEQ ID NO: 231 - protein, 417 aa, Artificial
  Substituion in SEQ ID NO 222
MTLMYLLWDTFYDALKLVTGLVALYQIVLSVYGIWHRRRPITHAPQKRFAIIIPAHNEECVIGPLLDSLKRQTYPAHLYDVHVIADNCTDGTAERARAHGAIVHVRENRAEQGKGYAIEWMLARLKEMGARYDAIVMFDADNLVHPDFLAIMNDHLCSGDRVIQGYLDTKNPFDSWISVSLAISYWFDNRLWQYARARLHLPCTLGGTGLCIDYPLLQEMGWKATGLTEDLEFGIRCVRRGIIPVWAHDARVYDEKPTSFAASFRQRLRWQQGHFQCAREHLVPMFLEGLRERNLAKIDMAIYLFQPMRSMLLFAGAMIVLGLHYLSPDPTDAASNPAALMVTQLWVAVNVILFLEVPLALLLERVNWRAYFALPLLPFFLWTWGPVTLQAYFTRSNRTWYHTVHKRAIRLDELRER

SEQ ID NO: 232 - protein, 417 aa, Artificial
  Substituion in SEQ ID NO 222
MTLMYLLWDTFYDALKLVTGLVALYQIVLSVYGIWHRRRPITHAPQKRFAIIIPAHNEECVIGPLLDSLKRQTYPAHLYDVHVIADNCTDGTAERARAHGAIVHVRENRAEQGKGYAIEWMLARLKEMGARYDAIVMFDADNLVHPDFLAIMNDHLCSGDRVIQGYLDTKNPFDSWISVSLAISYWFDNRLWQYARARLHLPCTLGGTGLCIDYPLLQEMGWKATGLTEDLEFGIRCVRRGIIPVWAHDARVYDEKPTSFAASFRQRLRWQQGHFQCAREHLVPMFLEGLRERNLAKIDMAIYLFQPMRSMLLFAGAMIVLGLHYLSPDPTDAASNPAALMVTNLWVAVNVILFLEVPLALLLERVNWRAYFALPLLPFFLWTWGPVTLQAYFTRSNRTWYHTIHKRAIRLDELRER

SEQ ID NO: 233 - protein, 417 aa, Artificial
  Substituion in SEQ ID NO 222
MTLMYLLWDTFYDALKLVTGLVALYQIVLSVYGLWHRRRPITHAPQKRFAIIIPAHNEECVIGPLLDSLKRQTYPAHLYDVHVIADNCTDGTAERARAHGAIVHVRENRAEQGKGYAIEWMLARLKEMGARYDAIVMFDADNLVHPDFLAIMNDHLCSGDRVIQGYLDTKNPFDSWISVSLAISYWFDNRLWQYARARLHLPCTLGGTGLCIDYPLLQEMGWKATGLTEDLEFGIRCVRRGIIPVWAHDARVYDEKPTSFAASFRQRLRWQQGHFQCAREHLVPMFLEGLRERNLAKIDMAIYLFQPMRSMLLFAGAMIVLGLHYLSPDPTDAASNPAALMVTNLWVAVNVILFLEVPLALLLERVNWRAYFALPLLPFFLWTWGPVTLQAYFTRSNRTWYHTVHKRAIRLDELRER

SEQ ID NO: 234 - DNA, 1254 bp, Artificial
  Substituion in SEQ ID NO 223
atgacattgatgtacttgctctgggacacgttctatgacgcgctgaagctcgtcacgggccttgtggcgctgtaccagattgtgctgtccgtgtacggcatctggcaccgcagacggcccatcacgcatgcgccgcagaagcgcttcgccatcatcattccggcgcacaacgaggagtgcgtgatcggcccgctcctcgacagcctgaagcgccagacgtatcccgcgcacctgtacgacgtgcatgtcatcgcggacaactgcacggacggcaccgcggagcgcgcgcgggcgcacggcgccattgtccacgtgcgcgaaaaccgcgcggaacagggcaaggggtacgccatcgaatggatgctggcgcgcctgaaggaaatgggcgctcgatacgacgccatcgtgatgttcgacgcggataatttggttcatccggactttctcgccatcatgaacgaccacctgtgcagcggcgatcgcgtcattcagggatatctggataccaagaatccattcgattcgtggatcagcgtgtcgctcgccatctcctattggttcgacaatcggctgtggcagtacgcccgcgcccgcctgcatctgccgtgtacgctcggtgggaccggcctttgcatcgattatccgctgttgcaggagatgggatggaaggcgacgggcctcaccgaggatctcgagttcgggattcgctgcgtccgccgaggaattatccccgtctgggcgcacgacgcgcgcgtctacgacgagaagccgacgagcttcgcggcgtctttccgccagcgcctgcgctggcagcaggggcatttccaatgtgcacgtgaacacttggtccccatgtttctcgaggggctgcgcgagcggaacttggccaaaatcgacatggccatttacctgtttcagcccatgcggtccatgctgctgtttgcgggcgccatgattgtgctcggccttcactacctgtcgcccgatccgaccgatgcagcgtccaacccggccgcgctcatggtcacgaatctgtgggtcgcggtgaacgtgatcctgtttctcgaggttcccctcgcgctgctgctcgaacggattaactggcgggcgtattttgccctgcccctccttccgttctttctctggacctggggccccgtgacgctgcaggcctacttcacgcgcagcaaccggacgtggtaccacacggtgcacaagcgcgccattcgcttggatgagctgcgcgagcggtaa

SEQ ID NO: 235 - DNA, 1254 bp, Artificial
  Substituion in SEQ ID NO 223
atgacattgatgtacttgctctgggacacgttctatgacgcgctgaagctcgtcacgggccttgtggcgctgtaccagattgtgctgtccgtgtacggcatctggcaccgcagacggcccatcacgcatgcgccgcagaagcgcttcgccatcatcattccggcgcacaacgaggagtgcgtgatcggcccgctcctcgacagcctgaagcgccagacgtatcccgcgcacctgtacgacgtgcatgtcatcgcggacaactgcacggacggcaccgcggagcgcgcgcgggcgcacggcgccattgtccacgtgcgcgaaaaccgcgcggaacagggcaaggggtacgccatcgaatggatgctggcgcgcctgaaggaaatgggcgctcgatacgacgccatcgtgatgttcgacgcggataatttggttcatccggactttctcgccatcatgaacgaccacctgtgcagcggcgatcgcgtcattcagggatatctggataccaagaatccattcgattcgtggatcagcgtgtcgctcgccatctcctattggttcgacaatcggctgtggcagtacgcccgcgcccgcctgcatctgccgtgtacgctcggtgggaccggcctttgcatcgattatccgctgttgcaggagatgggatggaaggcgacgggcctcaccgaggatctcgagttcgggattcgctgcgtccgccgaggaattatccccgtctgggcgcacgacgcgcgcgtctacgacgagaagccgacgagcttcgcggcgtctttccgccagcgcctgcgctggcagcaggggcatttccaatgtgcacgtgaacacttggtccccatgtttctcgaggggctgcgcgatcggaacttggccaaaatcgacatggccatttacctgtttcagcccatgcggtccatgctgctgtttgcgggcgccatgattgtgctcggccttcactacctgtcgcccgatccgaccgatgcagcgtccaacccggccgcgctcatggtcacgaatctgtgggtcgcggtgaacgtgatcctgtttctcgaggttcccctcgcgctgctgctcgaacgggtgaactggcgggcgtattttgccctgcccctccttccgttctttctctggacctggggccccgtgacgctgcaggcctacttcacgcgcagcaaccggacgtggtaccacacggtgcacaagcgcgccattcgcttggatgagctgcgcgagcggtaa

SEQ ID NO: 236 - DNA, 1254 bp, Artificial
  Substituion in SEQ ID NO 223
atgacattgatgtacttgctctgggacacgttctatgacgcgctgaagctcgtcacgggccttgtggcgctgtaccagattgtgctgtccgtgtacggcatctggcaccgcagacggcccatcacgcatgcgccgcagaagcgcttcgccatcatcattccggcgcacaacgaggagtgcgtgatcggcccgctcctcgacagcctgaagcgccagacgtatcccgcgcacctgtacgacgtgcatgtcatcgcggacaactgcacggacggcaccgcggagcgcgcgcgggcgcacggcgccattgtccacgtgcgcgaaaaccgcgcggaacagggcaaggggtacgccatcgaatggatgctggcgcgcctgaaggaaatgggcgctcgatacgacgccatcgtgatgttcgacgcggataatttggttcatccggactttctcgccatcatgaacgaccacctgtgcagcggcgatcgcgtcattcagggatatctggataccaagaatccattcgattcgtggatcagcgtgtcgctcgccatctcctattggttcgacaatcggctgtggcagtacgcccgcgcccgcctgcatctgccgtgtacgctcggtgggaccggcctttgcatcgattatccgctgttgcaggagatgggatggaaggcgacgggcctcaccgaggatctcgagttcgggattcgctgcgtccgccgaggaattatccccgtctgggcgcacgacgcgcgcgtctacgacgagaagccgacgagcttcgcggcgtctttccgccagcgcctgcgctggcagcaggggcatttccaatgtgcacgtgaacacttggtccccatgtttctcgaggggctgcgcgagcggaacttggccaaaatcgacatggccatttacctgtttcagcccatgcggtccatgctgctgtttgcgggcgccatgattgtgctcggccttcactacctgtcgcccgatccgaccgatgcagcgtccaacccggccgcgctcatggtcacgcaactgtgggtcgcggtgaacgtgatcctgtttctcgaggttcccctcgcgctgctgctcgaacgggtgaactggcgggcgtattttgccctgcccctccttccgttctttctctggacctggggccccgtgacgctgcaggcctacttcacgcgcagcaaccggacgtggtaccacacggtgcacaagcgcgccattcgcttggatgagctgcgcgagcggtaa

SEQ ID NO: 237 - DNA, 1254 bp, Artificial
  Substituion in SEQ ID NO 223
atgacattgatgtacttgctctgggacacgttctatgacgcgctgaagctcgtcacgggccttgtggcgctgtaccagattgtgctgtccgtgtacggcatctggcaccgcagacggcccatcacgcatgcgccgcagaagcgcttcgccatcatcattccggcgcacaacgaggagtgcgtgatcggcccgctcctcgacagcctgaagcgccagacgtatcccgcgcacctgtacgacgtgcatgtcatcgcggacaactgcacggacggcaccgcggagcgcgcgcgggcgcacggcgccattgtccacgtgcgcgaaaaccgcgcggaacagggcaaggggtacgccatcgaatggatgctggcgcgcctgaaggaaatgggcgctcgatacgacgccatcgtgatgttcgacgcggataatttggttcatccggactttctcgccatcatgaacgaccacctgtgcagcggcgatcgcgtcattcagggatatctggataccaagaatccattcgattcgtggatcagcgtgtcgctcgccatctcctattggttcgacaatcggctgtggcagtacgcccgcgcccgcctgcatctgccgtgtacgctcggtgggaccggcctttgcatcgattatccgctgttgcaggagatgggatggaaggcgacgggcctcaccgaggatctcgagttcgggattcgctgcgtccgccgaggaattatccccgtctgggcgcacgacgcgcgcgtctacgacgagaagccgacgagcttcgcggcgtctttccgccagcgcctgcgctggcagcaggggcatttccaatgtgcacgtgaacacttggtccccatgtttctcgaggggctgcgcgagcggaacttggccaaaatcgacatggccatttacctgtttcagcccatgcggtccatgctgctgtttgcgggcgccatgattgtgctcggccttcactacctgtcgcccgatccgaccgatgcagcgtccaacccggccgcgctcatggtcacgaatctgtgggtcgcggtgaacgtgatcctgtttctcgaggttcccctcgcgctgctgctcgaacgggtgaactggcgggcgtattttgccctgcccctccttccgttctttctctggacctggggccccgtgacgctgcaggcctacttcacgcgcagcaaccggacgtggtaccacacgattcacaagcgcgccattcgcttggatgagctgcgcgagcggtaa

SEQ ID NO: 238 - DNA, 1254 bp, Artificial
  Substituion in SEQ ID NO 223
atgacattgatgtacttgctctgggacacgttctatgacgcgctgaagctcgtcacgggccttgtggcgctgtaccagattgtgctgtccgtgtacggcttatggcaccgcagacggcccatcacgcatgcgccgcagaagcgcttcgccatcatcattccggcgcacaacgaggagtgcgtgatcggcccgctcctcgacagcctgaagcgccagacgtatcccgcgcacctgtacgacgtgcatgtcatcgcggacaactgcacggacggcaccgcggagcgcgcgcgggcgcacggcgccattgtccacgtgcgcgaaaaccgcgcggaacagggcaaggggtacgccatcgaatggatgctggcgcgcctgaaggaaatgggcgctcgatacgacgccatcgtgatgttcgacgcggataatttggttcatccggactttctcgccatcatgaacgaccacctgtgcagcggcgatcgcgtcattcagggatatctggataccaagaatccattcgattcgtggatcagcgtgtcgctcgccatctcctattggttcgacaatcggctgtggcagtacgcccgcgcccgcctgcatctgccgtgtacgctcggtgggaccggcctttgcatcgattatccgctgttgcaggagatgggatggaaggcgacgggcctcaccgaggatctcgagttcgggattcgctgcgtccgccgaggaattatccccgtctgggcgcacgacgcgcgcgtctacgacgagaagccgacgagcttcgcggcgtctttccgccagcgcctgcgctggcagcaggggcatttccaatgtgcacgtgaacacttggtccccatgtttctcgaggggctgcgcgagcggaacttggccaaaatcgacatggccatttacctgtttcagcccatgcggtccatgctgctgtttgcgggcgccatgattgtgctcggccttcactacctgtcgcccgatccgaccgatgcagcgtccaacccggccgcgctcatggtcacgaatctgtgggtcgcggtgaacgtgatcctgtttctcgaggttcccctcgcgctgctgctcgaacgggtgaactggcgggcgtattttgccctgcccctccttccgttctttctctggacctggggccccgtgacgctgcaggcctacttcacgcgcagcaaccggacgtggtaccacacggtgcacaagcgcgccattcgcttggatgagctgcgcgagcggtaa

SEQ ID NO: 239 - protein, 307 aa, Alicyclobacillus acidocaldarius
MTMRIAVLIPCYNEELTIGKVVQDFRRELPDAEIYVYDNNSRDRTAEVAREAGAIVRRETRQGKGNVVRSMFRDIDADVYVMTDGDDTYPAEFVHDLIRPIIEGEADMCIGDRHSDGSYSKENKRPFHNFGNQLVRKLINTLFHADLRDIMTGYRAFSRRFAKTMPIQSEGFEIETEMTLHALDKRFRILEIPIQYRDRPPGSHSKLNTLSDGIRVLKTVFWIFKDYKPLAFFTAVALILFLAGLGVGIPVLYEYFSFGRIAKIPSAILAVGFMVLATNSLTCGFILDTIVRHHRDYYELLQNEFKG

SEQ ID NO: 240 - DNA, 924 bp, Alicyclobacillus acidocaldarius
gtgaccatgcgaatcgcagtcctcatcccgtgttacaacgaagaactgaccattggaaaagtggttcaggactttaggcgcgaactgcccgacgcggagatttacgtgtacgacaacaactcgcgcgatcgcaccgcggaagtggcgagggaagcgggcgcgattgtgcgaagagagactcgtcagggcaagggaaacgtggtgcgctcgatgttccgcgacatcgacgccgacgtgtacgtcatgaccgacggagacgacacgtacccggcggaattcgtgcacgatctcattcggccgatcatcgaaggagaggccgacatgtgcatcggcgaccgtcactccgacggctcgtactccaaggagaacaagcgccctttccacaacttcggcaaccagttggtgcggaagctgatcaacaccctgtttcacgcagatctccgggacatcatgaccggctaccgggcgttcagccgccgcttcgccaagaccatgcccatccagagcgagggctttgaaatcgagacggaaatgacgctccacgcgctggacaagcgcttccgcatcctcgaaatcccgatccaataccgggatcggccgccgggcagccactccaagttgaacacgctgagcgacggcatccgggtgttgaagaccgtcttttggattttcaaagactacaagccgctcgctttcttcaccgccgtcgccttgatcctgtttttggccggcctcggcgtcggcattcccgtgttgtacgagtacttctcgtttggccgcatcgcgaagatcccgtccgccatcctcgcggtcggattcatggtgctggcgaccaacagcctgacgtgcggctttattctggacaccatcgtccgccatcaccgcgactactacgagctcttgcagaacgaatttaaaggctga

SEQ ID NO: 241 - protein, 304 aa, Clostridium acetobutylicum ATCC 824
MKIAVLIPCYNEELTIKKVITDFKKVLPDAYIYVYDNNSKDNTAAIAKESGAIVVREPRQGKGNVVRSMFKDIDADYYIMVDGDDTYPAEFAKELLKPIINGEADMTIGDRLSNGTYESENKRAFHNFGNKLVKNLIGKLFKNDINDIMTGYRAFNRYFVKTIPVLSSGFEIETEMSIHALDKKFLLKEIPIDYRDRPEGSSSKLNTYKDGLKVIKTILFLFKDYKPLPFFSILALLIFLIGLLVGSPVIIEFVKTHRISKLPSAVLTMGLITSAIMFFVNGLILDTLVKQNNQNYELFLNNYK

SEQ ID NO: 242 - protein, 300 aa, Streptococcus mutans UA159
MTEKIAILLPAYNEEITIQKVISDFKRVLPEADIYVYDNNSKDRTNELARQAGAIVRFESRQGKGNVVRSMFREINADYYIMVDADDTYPADEVQKLLDPLRSGKADMTIGDRLSNGTYAEENKRGFHGFGNNLVRLLVNHLYQGNYQDIMTGYRGFNRLFVKNFPVLSSGFEIETELSIHSLDKRFKLVEVPITYHDRPEGSESKLNTFSDGFKVLCMIFNLFKDYKPLIFFSLVTLFFFILGLIVGVPVVTEFAETGFIAKMPSAILATGFMILAALSFALGFILDTIVRQNRMQYEL

SEQ ID NO: 243 - protein, 300 aa, Streptococcus mutans
MTEKIAVLLPAYNEEITIERVIKDFQNVLPNADIYVYDNNSKDRTNELAKQSGAIVRFEPRQGKGNVVRSMFREIEADYYIMVDADDTYPAAEVNKLLEPLKNGMADMTIGDRLSNGTYSQENKRGFHDFGNNLVKYLINKLYQGHYNDIMTGYRGFNRLFVKNFPVISPGFEIETEMSIHALDKRFKLVEVPITYKDRPEGSESKLNTFSDGFKVLKMIFNLFKDYKPLIFFSLLTVVMFILGLIIGIPVITEFAKTGMIDKLPSAILATGFMILAALSFVSGFILDTVVRQNRMQYEL

SEQ ID NO: 244 - protein, 297 aa, Enterococcus faecium DO
KIAVLIPCYNEEATISTVIADFKRELPEADIYVYDNNSTDRTYELAVQGGAIVKKEPRQGKGNVIRQMFFDIDADYYLMVDGDDTYPAEAVHGLLEKLRSGEADMVIGDRLSNGTYFDENKRPFHDFGNNLVRNTITRMYKTKILDVMTGYRGFNRIFVKSFPIMSSGFQIETELTIHALDKKFKFVEIPIDYRDRPEGSESKLNTFSDGFKVIMMIIKMFKDYKPLLFFGIWTIFFFLFGLVTGIPVIREYMLTSFITRIPSAILSTGLMTLALLSLVTGLILDTVVTNAKKEYEL

SEQ ID NO: 245 - protein, 297 aa, Listeria monocytogenes str. 4b F2365
KVAVLLPCYNEELTIGKVIDDFKKELPNADIYVYDNNSKDKTFEIAKDHGAIVRKEMRQGKGNVVRSMFADIDADYYLMVDGDDTYPAEYCHEILEVLRNKEANMVIGDRLSNGTYTEENKRNFHDFGNSLVRNTINRIFKSNLRDIMTGYRGFDRYFVKTMPVLSPGFEIETEMSIHALENRFLVKEIEIDYRDRPEGSESKLNTFSDGFKVIMTIVRLFKNSRPFLFFNLLASLFVLVGVLVGLPVIIQFAQIGLVLKFPSALLATGLIIMGMLFFICGLILDTIAHRSRQSYFL

SEQ ID NO: 246 - protein, 307 aa, Artificial
  Substituion in SEQ ID NO 239
MTMRIAVLIPCYNEELTIGKVVQDFRRELPDAEIYVYDNNSRDRTAEVAREAGAIVRRETRQGKGNVVRSMFRDIDADVYVMTDGDDTYPAEFVHDLIRPIIEGEADMCIGDRHSDGSYSKENKRPFHNFGNQLVRKLINTLFHADLRDIMTGYRAFSRRFAKTMPIQSEGFEIETEMTLHALDKRFRILEIPIQYRDRPPGSHSKLNTLSDGIRVLKTVFWIFKDYKPLAFFTAVALILFLAGLGVGIPVLYEYFSFGRIAKIPSAILAVGFMILATNSLTCGFILDTIVRHHRDYYELLQNEFKG

SEQ ID NO: 247 - protein, 307 aa, Artificial
  Substituion in SEQ ID NO 239
MTMRIAVLIPCYNEELTIGKVVQDFRRELPDAEIYVYDNNSRDRTAEVAREAGAIVRRETRQGKGNVVRSMFRDIDADVYVMTDGDDTYPAEFVHDLIRPIIEGEADMCIGDRHSDGSYSKENKRPFHNFGNQLVRKLINTLFHADIRDIMTGYRAFSRRFAKTMPIQSEGFEIETEMTLHALDKRFRILEIPIQYRDRPPGSHSKLNTLSDGIRVLKTVFWIFKDYKPLAFFTAVALILFLAGLGVGIPVLYEYFSFGRIAKIPSAILAVGFMVLATNSLTCGFILDTIVRHHRDYYELLQNEFKG

SEQ ID NO: 248 - protein, 307 aa, Artificial
  Substituion in SEQ ID NO 239
MTMRIAVLIPCYNEELTIGKVVNDFRRELPDAEIYVYDNNSRDRTAEVAREAGAIVRRETRQGKGNVVRSMFRDIDADVYVMTDGDDTYPAEFVHDLIRPIIEGEADMCIGDRHSDGSYSKENKRPFHNFGNQLVRKLINTLFHADLRDIMTGYRAFSRRFAKTMPIQSEGFEIETEMTLHALDKRFRILEIPIQYRDRPPGSHSKLNTLSDGIRVLKTVFWIFKDYKPLAFFTAVALILFLAGLGVGIPVLYEYFSFGRIAKIPSAILAVGFMVLATNSLTCGFILDTIVRHHRDYYELLQNEFKG

SEQ ID NO: 249 - protein, 307 aa, Artificial
  Substituion in SEQ ID NO 239
MTMRIAVLIPCYNEELTIGKVVQDFRRELPDAEIYVYDNNSRDRTAEVAREAGAIVRRETRQGKGNVVRSMFRDIDADVYVMTDGDDTYPAEFVHDLIRPIIEGEADMCIGDRHSDGSYSKENKRPFHNFGNQLVRKLINTLFHADLKDIMTGYRAFSRRFAKTMPIQSEGFEIETEMTLHALDKRFRILEIPIQYRDRPPGSHSKLNTLSDGIRVLKTVFWIFKDYKPLAFFTAVALILFLAGLGVGIPVLYEYFSFGRIAKIPSAILAVGFMVLATNSLTCGFILDTIVRHHRDYYELLQNEFKG

SEQ ID NO: 250 - protein, 307 aa, Artificial
  Substituion in SEQ ID NO 239
MTMRIAVLIPCYNEELTIGKVVQDFRRELPDAEIYVYDNNSRDRTAEVAREAGAIVRRETRQGKGNVVRSMFRDIDADVYVMTDGDDTYPAEFVHDLIRPIIEGEADMCIGDRHSDGSYSKENKRPFHNFGNQLVRKLINTLFHADLRDIMTGYRAFSRRFAKTMPIQSEGFEIETEMTLHALDKRFRILEIPIQYRDRPPGSHSKLNTLSDGIRVLKTVFWIFKDYKPLAFFTAVALILFLAGLGVGLPVLYEYFSFGRIAKIPSAILAVGFMVLATNSLTCGFILDTIVRHHRDYYELLQNEFKG

SEQ ID NO: 251 - DNA, 924 bp, Artificial
  Substituion in SEQ ID NO 240
gtgaccatgcgaatcgcagtcctcatcccgtgttacaacgaagaactgaccattggaaaagtggttcaggactttaggcgcgaactgcccgacgcggagatttacgtgtacgacaacaactcgcgcgatcgcaccgcggaagtggcgagggaagcgggcgcgattgtgcgaagagagactcgtcagggcaagggaaacgtggtgcgctcgatgttccgcgacatcgacgccgacgtgtacgtcatgaccgacggagacgacacgtacccggcggaattcgtgcacgatctcattcggccgatcatcgaaggagaggccgacatgtgcatcggcgaccgtcactccgacggctcgtactccaaggagaacaagcgccctttccacaacttcggcaaccagttggtgcggaagctgatcaacaccctgtttcacgcagatctccgggacatcatgaccggctaccgggcgttcagccgccgcttcgccaagaccatgcccatccagagcgagggctttgaaatcgagacggaaatgacgctccacgcgctggacaagcgcttccgcatcctcgaaatcccgatccaataccgggatcggccgccgggcagccactccaagttgaacacgctgagcgacggcatccgggtgttgaagaccgtcttttggattttcaaagactacaagccgctcgctttcttcaccgccgtcgccttgatcctgtttttggccggcctcggcgtcggcattcccgtgttgtacgagtacttctcgtttggccgcatcgcgaagatcccgtccgccatcctcgcggtcggattcatgattctggcgaccaacagcctgacgtgcggctttattctggacaccatcgtccgccatcaccgcgactactacgagctcttgcagaacgaatttaaaggctga

SEQ ID NO: 252 - DNA, 924 bp, Artificial
  Substituion in SEQ ID NO 240
gtgaccatgcgaatcgcagtcctcatcccgtgttacaacgaagaactgaccattggaaaagtggttcaggactttaggcgcgaactgcccgacgcggagatttacgtgtacgacaacaactcgcgcgatcgcaccgcggaagtggcgagggaagcgggcgcgattgtgcgaagagagactcgtcagggcaagggaaacgtggtgcgctcgatgttccgcgacatcgacgccgacgtgtacgtcatgaccgacggagacgacacgtacccggcggaattcgtgcacgatctcattcggccgatcatcgaaggagaggccgacatgtgcatcggcgaccgtcactccgacggctcgtactccaaggagaacaagcgccctttccacaacttcggcaaccagttggtgcggaagctgatcaacaccctgtttcacgcagatattcgggacatcatgaccggctaccgggcgttcagccgccgcttcgccaagaccatgcccatccagagcgagggctttgaaatcgagacggaaatgacgctccacgcgctggacaagcgcttccgcatcctcgaaatcccgatccaataccgggatcggccgccgggcagccactccaagttgaacacgctgagcgacggcatccgggtgttgaagaccgtcttttggattttcaaagactacaagccgctcgctttcttcaccgccgtcgccttgatcctgtttttggccggcctcggcgtcggcattcccgtgttgtacgagtacttctcgtttggccgcatcgcgaagatcccgtccgccatcctcgcggtcggattcatggtgctggcgaccaacagcctgacgtgcggctttattctggacaccatcgtccgccatcaccgcgactactacgagctcttgcagaacgaatttaaaggctga

SEQ ID NO: 253 - DNA, 924 bp, Artificial
  Substituion in SEQ ID NO 240
gtgaccatgcgaatcgcagtcctcatcccgtgttacaacgaagaactgaccattggaaaagtggttaatgactttaggcgcgaactgcccgacgcggagatttacgtgtacgacaacaactcgcgcgatcgcaccgcggaagtggcgagggaagcgggcgcgattgtgcgaagagagactcgtcagggcaagggaaacgtggtgcgctcgatgttccgcgacatcgacgccgacgtgtacgtcatgaccgacggagacgacacgtacccggcggaattcgtgcacgatctcattcggccgatcatcgaaggagaggccgacatgtgcatcggcgaccgtcactccgacggctcgtactccaaggagaacaagcgccctttccacaacttcggcaaccagttggtgcggaagctgatcaacaccctgtttcacgcagatctccgggacatcatgaccggctaccgggcgttcagccgccgcttcgccaagaccatgcccatccagagcgagggctttgaaatcgagacggaaatgacgctccacgcgctggacaagcgcttccgcatcctcgaaatcccgatccaataccgggatcggccgccgggcagccactccaagttgaacacgctgagcgacggcatccgggtgttgaagaccgtcttttggattttcaaagactacaagccgctcgctttcttcaccgccgtcgccttgatcctgtttttggccggcctcggcgtcggcattcccgtgttgtacgagtacttctcgtttggccgcatcgcgaagatcccgtccgccatcctcgcggtcggattcatggtgctggcgaccaacagcctgacgtgcggctttattctggacaccatcgtccgccatcaccgcgactactacgagctcttgcagaacgaatttaaaggctga

SEQ ID NO: 254 - DNA, 924 bp, Artificial
  Substituion in SEQ ID NO 240
gtgaccatgcgaatcgcagtcctcatcccgtgttacaacgaagaactgaccattggaaaagtggttcaggactttaggcgcgaactgcccgacgcggagatttacgtgtacgacaacaactcgcgcgatcgcaccgcggaagtggcgagggaagcgggcgcgattgtgcgaagagagactcgtcagggcaagggaaacgtggtgcgctcgatgttccgcgacatcgacgccgacgtgtacgtcatgaccgacggagacgacacgtacccggcggaattcgtgcacgatctcattcggccgatcatcgaaggagaggccgacatgtgcatcggcgaccgtcactccgacggctcgtactccaaggagaacaagcgccctttccacaacttcggcaaccagttggtgcggaagctgatcaacaccctgtttcacgcagatctcaaagacatcatgaccggctaccgggcgttcagccgccgcttcgccaagaccatgcccatccagagcgagggctttgaaatcgagacggaaatgacgctccacgcgctggacaagcgcttccgcatcctcgaaatcccgatccaataccgggatcggccgccgggcagccactccaagttgaacacgctgagcgacggcatccgggtgttgaagaccgtcttttggattttcaaagactacaagccgctcgctttcttcaccgccgtcgccttgatcctgtttttggccggcctcggcgtcggcattcccgtgttgtacgagtacttctcgtttggccgcatcgcgaagatcccgtccgccatcctcgcggtcggattcatggtgctggcgaccaacagcctgacgtgcggctttattctggacaccatcgtccgccatcaccgcgactactacgagctcttgcagaacgaatttaaaggctga

SEQ ID NO: 255 - DNA, 924 bp, Artificial
  Substituion in SEQ ID NO 240
gtgaccatgcgaatcgcagtcctcatcccgtgttacaacgaagaactgaccattggaaaagtggttcaggactttaggcgcgaactgcccgacgcggagatttacgtgtacgacaacaactcgcgcgatcgcaccgcggaagtggcgagggaagcgggcgcgattgtgcgaagagagactcgtcagggcaagggaaacgtggtgcgctcgatgttccgcgacatcgacgccgacgtgtacgtcatgaccgacggagacgacacgtacccggcggaattcgtgcacgatctcattcggccgatcatcgaaggagaggccgacatgtgcatcggcgaccgtcactccgacggctcgtactccaaggagaacaagcgccctttccacaacttcggcaaccagttggtgcggaagctgatcaacaccctgtttcacgcagatctccgggacatcatgaccggctaccgggcgttcagccgccgcttcgccaagaccatgcccatccagagcgagggctttgaaatcgagacggaaatgacgctccacgcgctggacaagcgcttccgcatcctcgaaatcccgatccaataccgggatcggccgccgggcagccactccaagttgaacacgctgagcgacggcatccgggtgttgaagaccgtcttttggattttcaaagactacaagccgctcgctttcttcaccgccgtcgccttgatcctgtttttggccggcctcggcgtcggcttacccgtgttgtacgagtacttctcgtttggccgcatcgcgaagatcccgtccgccatcctcgcggtcggattcatggtgctggcgaccaacagcctgacgtgcggctttattctggacaccatcgtccgccatcaccgcgactactacgagctcttgcagaacgaatttaaaggctga

SEQ ID NO: 256 - protein, 408 aa, Alicyclobacillus acidocaldarius
MRGSAMMDRAKPRIGRPWRKEALCVDVSVVIPTYNERDNIHPLVERIHQALAPLGISYEIWFVDDSSDDTVAVLRDLEARDPAVHVFHRDHERGLASAVVRGFEKAQGRYLVVMDADLQHPPELLPAIYERLESGIDVVIPSRFVEGGSDGGLGPLRKLISWTARVIGQLALHRLRKISDCTSGFFGLRREVIEGVELNPIGWKILIEVLVKGRYRSVHEIAYEFVARDFGESKMSLKEQWNYFRHLVRLVSQSPPDRRFFLFCLIGLSGVVVNEAVLSLLWYGFHLRDTVASVAASFVAMLNNYFWNDRVTWKSESSGRGWGWKLPVFVGISVVGIAITTLVMRGCEGFGVPVPAGQAIGILVSTAWSYWMNSRVTWRNIEREARGDAIVVTRESVRDSLMRAKTGA

SEQ ID NO: 257 - DNA, 1227 bp, Alicyclobacillus acidocaldarius
gtgcgtggttccgcgatgatggacagggccaagcctcggatcggtaggccttggcgcaaggaggctttgtgcgtggacgtcagtgtggtgatcccgacttacaacgagcgagacaacatccatcccctggtggagcgcatccatcaagctttagcccctctggggatttcctacgagatctggtttgtcgatgacagcagcgacgatacggtcgcagtgcttcgagatctggaggcccgggatcccgccgttcacgtgttccaccgcgatcacgagcgtggcctcgcgagcgcggtcgtgcgtggattcgaaaaggcgcagggcaggtaccttgtcgtgatggacgctgacctgcagcatccgccggagctgttgccggccatctacgagcgtttggagtccgggatcgacgtggtaatcccaagccgtttcgtggaagggggctcggacggcgggttgggcccgctgcgaaagctcatctcgtggaccgcgcgggtcattgggcaactcgcgctccatcgcctgcgcaagatctcggattgcacgagcggtttctttggcctgcggcgcgaagtgattgaaggcgtcgaactgaaccccattggatggaagatcttgatcgaggtgctggtgaaaggccgctatcgcagcgtgcatgagatcgcgtacgagttcgtggcccgcgacttcggcgaatcgaagatgagcctcaaggagcagtggaactactttcgccacctcgtgcgcctggtgagccagagcccgccggatcggcggttctttctgttctgcctcatcggcctgtcgggcgtggtggtgaacgaggcagtcctgagcctcctgtggtacgggttccacctgcgggacaccgtggcttccgtcgccgcttctttcgtggccatgttgaacaactatttttggaacgatcgcgtcacgtggaaatccgagtcctccggacgagggtggggatggaagctgcccgtgttcgtcggcatttcggtcgtcgggatcgccatcacgacgctcgtgatgcgaggatgcgagggctttggcgtgcccgttcccgctggacaggccatcggcatcctggtgtccacagcgtggtcgtattggatgaacagccgcgtgacttggcgaaacatcgagcgcgaagcgcgtggggatgcgattgtggtcacacgggagtcggtgcgggattcgctgatgcgggcgaaaacaggcgcgtga

SEQ ID NO: 258 - protein, 376 aa, Syntrophomonas wolfei subsp. wolfei str. Goettingen
LSIIIPTYNERDNVLRIAEHIGNTLKNSYEIVFVDDSNDDTPEILQYLSKSDPHLRFEHRHKERGLGTAVVRGFEIASGDVIAVMDADLQHPPEVLLSMLKAIESGADIVIPSRFIPGGNDGGLKLHRKIVSATARYIGKALIKKLRPISDSTSGFFMFRKDVIKEAELQPIGWKILIEVLARGKYTRVIEIPYQFQARTAGESKMSAQEQWNYIRHLMRLVKDSPEDRRFFYFSLVGLSGVFVNMLIYFFLTMLNLEVRIAGFCSAFVAMLVNFVLNDKITWAYVKTNSVWSRGSKYIITSLIGIGINVGVLDFFYYQLQFNHLLSNLIGISCAVFWNYTINNLWTWSTAKHNNTIIERWTVQNGCESSVEKTGS

SEQ ID NO: 259 - protein, 349 aa, Thermococcus kodakarensis KOD1
ISVVIPTYNERENLPELVERLSRALQGYEYEIVIVDDDSPDKTWGLAEELARKYPIKVIRRTKEKGLSSAVIRGFKEASGDVFVVMDADLQHPPEKVPELIEAIKRGADIAIASRYVPGGAVKNWYWYRKLISKGAIMIGRVALPRIRNVKDPVSGFFALRREVVEGVELNPVGFKILMEILVKGHYNNVREVPFTFGLRKAGESKLGSRTIVNYLRHIYRLMRWEGEIDRLVKFSLVGLSGVLVNEGFLWAFVEFFGWDKVFSNILATELAILNNFTWNDIWTFRDLKNKPLLKRLVSFHVAALSGALVQWAIYVILMAVGVHYLLANLIGIVVSFIVRFAVNRHVTW

SEQ ID NO: 260 - protein, 348 aa, Pyrococcus furiosus DSM 3638
VSVIIPTYNERENLEELFSRIDNALQGLNYEIVVVDDDSPDRTWEKAQELSSKYPVKVIRRTKEKGLSSAVIRGFKEASGDVFVVMDADLQHPPEVIPKLIEAIKNGSDIAIGSRYVKGGKVENWPFYRKLISKGAIMVGRIALPKIRDIKDPVSGFFALRKEVVEGVELNPIGFKILMEILIKGKYSKVVEVPFTFGIRARGESKLKGKTIFEYLRHIYRLMKWEGEIDRIVKFSIVGLSGILVNEGFLWLFVNLGIPKEIAVIPAVELSILNNFFWNDIWTFKDIRRGSIFSRLLKFHIAALSGAVVNFIVYWILLFLGIHYLIANLVGIVLSFGVRYVINRHVTW

SEQ ID NO: 261 - protein, 349 aa, Pyrococcus horikoshii OT3
VSIIVPTYNERDNLEELFSRISSALKGYDYEIIIVDDDSPDKTWEKAMELSKLYPVKVIRRVNEKGLSSAVIRGFSEASGDVFVVMDADLQHPPEVIPSLLREIEKGNDIAIASRYVKGGKVENWPFYRRLISRGAIIIGRLALPKIAGIKDPVSGFFALKRSVVEGVKLNPIGFKILMEILIKGKYSRVTEVPFTFSTRKFGESKLKGKTMVNYLRHVYRLMKWEGEVDRILKFSIVGLSGVGVNEGFLWLFVNFFHISKELGVIPSTELSILNNFLWNDLWTFKDIKKGSVIERLAKFHVAAFVGAVAQFLVYWILLFLGIHYLLANLFGIGASFVVRYIFNRHITW

SEQ ID NO: 262 - protein, 353 aa, Pyrococcus abyssi GE5
ALIMKVSVIVPTYNERENLEELFSRIDKALKDYDYEIIVVDDDSPDETWKKAQELSSVYPVKVIRRINEKGLSSAVIRGFKEASGDVFVVMDADLQHPPEVIPELLKRIKEGADLAIASRYVKGGRVENWPLYRKLISKGAIMIARVALPKIRSIKDPVSGFFALKRNVVDNVNLNPIGFKILLEILIKGRYSRVEEVPFTFGTRLSGESKLKGKTMLNYLRHVYRLMKWEGEIDRLVKFSIVGLSGVAVNEGFLWLFVKMGIRKEVAVLPSTELSVINNFIWNDLWTFKDLRKGSVLRRFFQFHIAALIGVFAQLLIYWALLFLGVHYLISNLVGIGASFIVRYIFNRHVTW

SEQ ID NO: 263 - protein, 408 aa, Artificial
  Substituion in SEQ ID NO 256
MRGSAMMDRAKPRIGRPWRKEALCVDVSVVIPTYNERDNIHPLVERIHQALAPLGISYEIWFVDDSSDDTVAVLKDLEARDPAVHVFHRDHERGLASAVVRGFEKAQGRYLVVMDADLQHPPELLPAIYERLESGIDVVIPSRFVEGGSDGGLGPLRKLISWTARVIGQLALHRLRKISDCTSGFFGLRREVIEGVELNPIGWKILIEVLVKGRYRSVHEIAYEFVARDFGESKMSLKEQWNYFRHLVRLVSQSPPDRRFFLFCLIGLSGVVVNEAVLSLLWYGFHLRDTVASVAASFVAMLNNYFWNDRVTWKSESSGRGWGWKLPVFVGISVVGIAITTLVMRGCEGFGVPVPAGQAIGILVSTAWSYWMNSRVTWRNIEREARGDAIVVTRESVRDSLMRAKTGA

SEQ ID NO: 264 - protein, 408 aa, Artificial
  Substituion in SEQ ID NO 256
MRGSAMMDRAKPRIGRPWRKEALCVDVSVVIPTYNERDNIHPLVERIHQALAPLGISYEIWFVDDSSDDTVAVLRDLEARDPAVHVFHRDHERGLASAVVRGFEKAQGRYLVVMDADLQHPPELLPAIYERLESGIDVVIPSRFVEGGSDGGLGPLRKLISWTARVIGQLALHRLRKISDCTSGFFGLRREVIEGVELNPIGWKILIEVLVKGRYRSVHEIAYEFVARDFGESKMSLKEQWNYFRHLVRLVSQSPPDRRFFLFCLIGLSGVVVNEAVLSLLWYGFHLRDTVASVAASFVAMLNNYFWNDRVTWKSESSGRGWGWKLPVFVGISVVGIAITTLVMRGCEGFGVPVPAGQAIGILVSTAWSYWMNSRVTWRNIERDARGDAIVVTRESVRDSLMRAKTGA

SEQ ID NO: 265 - protein, 408 aa, Artificial
  Substituion in SEQ ID NO 256
MRGSAMMDRAKPRIGRPWRKEALCVDVSVVIPTYNERDNIHPLVERIHQALAPLGISYEIWFVDDSSDDTVAVLRDLEARDPAVHVFHRDHERGLASAVVRGFEKAQGRYLVVMDADLQHPPELLPAIYERLESGIDVVIPSRFVEGGSDGGLGPLRKLISWTARVIGQLALHRLRKISDCTSGFFGLRREVIEGVELNPIGWKILIEVLVKGRYRSVHEIAYEFVARDFGESKMSLKEQWNYFRHLVRLVSQSPPDRRFFLFCLIGLSGVVVNEAVLSLLWYGFHLRDTVASVAASFVAMLNNYFWNDRVTWKSESSGRGWGWKLPVFVGISVVGIAITTLVMRGCEGFGVPVPAGQAIGILVSTAWSYWMNSRVTWRNIEREARGDAIVVTRESVRDSLMRARTGA

SEQ ID NO: 266 - protein, 408 aa, Artificial
  Substituion in SEQ ID NO 256
MRGSAMMDRAKPRIGRPWRKEALCVDVSVVIPTYNERDNIHPLVERIHQALAPLGISYEIWFVDDSSDDTVAVLRDLEARDPAVHVFHRDHERGLASAVVRGFEKAQGRYLVVMDADLQHPPELLPAIYERLESGIDVVIPSRFVEGGSDGGLGPLRKLISWTARVIGQLALHRLRKISDCTSGFFGLRREVIEGVELNPIGWKILIEVLVKGRYRSVHEIAYEFVARDFGESKMSLKEQWNYFRHLVRLVSQSPPDRRFFLFCLIGLSGVVVNEAVLSLLWYGFHLRDTVASVAASFVAMLNNYFWNDRVTWKSESSGRGWGWKLPVFVGISVVGIAITTLVMRGCEGFGVPVPAGQAIGILVSTAWSYWMNSRVTWRNIDREARGDAIVVTRESVRDSLMRAKTGA

SEQ ID NO: 267 - protein, 408 aa, Artificial
  Substituion in SEQ ID NO 256
MRGSAMMDRAKPRIGRPWRKEALCVDVSVVIPTYNERDNIHPLVERIHQALAPLGISYEIWFVDDSSDDTVAVLRDLEARDPAVHVFHRDHERGLASAVVRGFEKAQGRYLVVMDADLQHPPEILPAIYERLESGIDVVIPSRFVEGGSDGGLGPLRKLISWTARVIGQLALHRLRKISDCTSGFFGLRREVIEGVELNPIGWKILIEVLVKGRYRSVHEIAYEFVARDFGESKMSLKEQWNYFRHLVRLVSQSPPDRRFFLFCLIGLSGVVVNEAVLSLLWYGFHLRDTVASVAASFVAMLNNYFWNDRVTWKSESSGRGWGWKLPVFVGISVVGIAITTLVMRGCEGFGVPVPAGQAIGILVSTAWSYWMNSRVTWRNIEREARGDAIVVTRESVRDSLMRAKTGA

SEQ ID NO: 268 - DNA, 1227 bp, Artificial
  Substituion in SEQ ID NO 257
gtgcgtggttccgcgatgatggacagggccaagcctcggatcggtaggccttggcgcaaggaggctttgtgcgtggacgtcagtgtggtgatcccgacttacaacgagcgagacaacatccatcccctggtggagcgcatccatcaagctttagcccctctggggatttcctacgagatctggtttgtcgatgacagcagcgacgatacggtcgcagtgcttaaagatctggaggcccgggatcccgccgttcacgtgttccaccgcgatcacgagcgtggcctcgcgagcgcggtcgtgcgtggattcgaaaaggcgcagggcaggtaccttgtcgtgatggacgctgacctgcagcatccgccggagctgttgccggccatctacgagcgtttggagtccgggatcgacgtggtaatcccaagccgtttcgtggaagggggctcggacggcgggttgggcccgctgcgaaagctcatctcgtggaccgcgcgggtcattgggcaactcgcgctccatcgcctgcgcaagatctcggattgcacgagcggtttctttggcctgcggcgcgaagtgattgaaggcgtcgaactgaaccccattggatggaagatcttgatcgaggtgctggtgaaaggccgctatcgcagcgtgcatgagatcgcgtacgagttcgtggcccgcgacttcggcgaatcgaagatgagcctcaaggagcagtggaactactttcgccacctcgtgcgcctggtgagccagagcccgccggatcggcggttctttctgttctgcctcatcggcctgtcgggcgtggtggtgaacgaggcagtcctgagcctcctgtggtacgggttccacctgcgggacaccgtggcttccgtcgccgcttctttcgtggccatgttgaacaactatttttggaacgatcgcgtcacgtggaaatccgagtcctccggacgagggtggggatggaagctgcccgtgttcgtcggcatttcggtcgtcgggatcgccatcacgacgctcgtgatgcgaggatgcgagggctttggcgtgcccgttcccgctggacaggccatcggcatcctggtgtccacagcgtggtcgtattggatgaacagccgcgtgacttggcgaaacatcgagcgcgaagcgcgtggggatgcgattgtggtcacacgggagtcggtgcgggattcgctgatgcgggcgaaaacaggcgcgtga

SEQ ID NO: 269 - DNA, 1227 bp, Artificial
  Substituion in SEQ ID NO 257
gtgcgtggttccgcgatgatggacagggccaagcctcggatcggtaggccttggcgcaaggaggctttgtgcgtggacgtcagtgtggtgatcccgacttacaacgagcgagacaacatccatcccctggtggagcgcatccatcaagctttagcccctctggggatttcctacgagatctggtttgtcgatgacagcagcgacgatacggtcgcagtgcttcgagatctggaggcccgggatcccgccgttcacgtgttccaccgcgatcacgagcgtggcctcgcgagcgcggtcgtgcgtggattcgaaaaggcgcagggcaggtaccttgtcgtgatggacgctgacctgcagcatccgccggagctgttgccggccatctacgagcgtttggagtccgggatcgacgtggtaatcccaagccgtttcgtggaagggggctcggacggcgggttgggcccgctgcgaaagctcatctcgtggaccgcgcgggtcattgggcaactcgcgctccatcgcctgcgcaagatctcggattgcacgagcggtttctttggcctgcggcgcgaagtgattgaaggcgtcgaactgaaccccattggatggaagatcttgatcgaggtgctggtgaaaggccgctatcgcagcgtgcatgagatcgcgtacgagttcgtggcccgcgacttcggcgaatcgaagatgagcctcaaggagcagtggaactactttcgccacctcgtgcgcctggtgagccagagcccgccggatcggcggttctttctgttctgcctcatcggcctgtcgggcgtggtggtgaacgaggcagtcctgagcctcctgtggtacgggttccacctgcgggacaccgtggcttccgtcgccgcttctttcgtggccatgttgaacaactatttttggaacgatcgcgtcacgtggaaatccgagtcctccggacgagggtggggatggaagctgcccgtgttcgtcggcatttcggtcgtcgggatcgccatcacgacgctcgtgatgcgaggatgcgagggctttggcgtgcccgttcccgctggacaggccatcggcatcctggtgtccacagcgtggtcgtattggatgaacagccgcgtgacttggcgaaacatcgagcgcgatgcgcgtggggatgcgattgtggtcacacgggagtcggtgcgggattcgctgatgcgggcgaaaacaggcgcgtga

SEQ ID NO: 270 - DNA, 1227 bp, Artificial
  Substituion in SEQ ID NO 257
gtgcgtggttccgcgatgatggacagggccaagcctcggatcggtaggccttggcgcaaggaggctttgtgcgtggacgtcagtgtggtgatcccgacttacaacgagcgagacaacatccatcccctggtggagcgcatccatcaagctttagcccctctggggatttcctacgagatctggtttgtcgatgacagcagcgacgatacggtcgcagtgcttcgagatctggaggcccgggatcccgccgttcacgtgttccaccgcgatcacgagcgtggcctcgcgagcgcggtcgtgcgtggattcgaaaaggcgcagggcaggtaccttgtcgtgatggacgctgacctgcagcatccgccggagctgttgccggccatctacgagcgtttggagtccgggatcgacgtggtaatcccaagccgtttcgtggaagggggctcggacggcgggttgggcccgctgcgaaagctcatctcgtggaccgcgcgggtcattgggcaactcgcgctccatcgcctgcgcaagatctcggattgcacgagcggtttctttggcctgcggcgcgaagtgattgaaggcgtcgaactgaaccccattggatggaagatcttgatcgaggtgctggtgaaaggccgctatcgcagcgtgcatgagatcgcgtacgagttcgtggcccgcgacttcggcgaatcgaagatgagcctcaaggagcagtggaactactttcgccacctcgtgcgcctggtgagccagagcccgccggatcggcggttctttctgttctgcctcatcggcctgtcgggcgtggtggtgaacgaggcagtcctgagcctcctgtggtacgggttccacctgcgggacaccgtggcttccgtcgccgcttctttcgtggccatgttgaacaactatttttggaacgatcgcgtcacgtggaaatccgagtcctccggacgagggtggggatggaagctgcccgtgttcgtcggcatttcggtcgtcgggatcgccatcacgacgctcgtgatgcgaggatgcgagggctttggcgtgcccgttcccgctggacaggccatcggcatcctggtgtccacagcgtggtcgtattggatgaacagccgcgtgacttggcgaaacatcgagcgcgaagcgcgtggggatgcgattgtggtcacacgggagtcggtgcgggattcgctgatgcgggcgcgtacaggcgcgtga

SEQ ID NO: 271 - DNA, 1227 bp, Artificial
  Substituion in SEQ ID NO 257
gtgcgtggttccgcgatgatggacagggccaagcctcggatcggtaggccttggcgcaaggaggctttgtgcgtggacgtcagtgtggtgatcccgacttacaacgagcgagacaacatccatcccctggtggagcgcatccatcaagctttagcccctctggggatttcctacgagatctggtttgtcgatgacagcagcgacgatacggtcgcagtgcttcgagatctggaggcccgggatcccgccgttcacgtgttccaccgcgatcacgagcgtggcctcgcgagcgcggtcgtgcgtggattcgaaaaggcgcagggcaggtaccttgtcgtgatggacgctgacctgcagcatccgccggagctgttgccggccatctacgagcgtttggagtccgggatcgacgtggtaatcccaagccgtttcgtggaagggggctcggacggcgggttgggcccgctgcgaaagctcatctcgtggaccgcgcgggtcattgggcaactcgcgctccatcgcctgcgcaagatctcggattgcacgagcggtttctttggcctgcggcgcgaagtgattgaaggcgtcgaactgaaccccattggatggaagatcttgatcgaggtgctggtgaaaggccgctatcgcagcgtgcatgagatcgcgtacgagttcgtggcccgcgacttcggcgaatcgaagatgagcctcaaggagcagtggaactactttcgccacctcgtgcgcctggtgagccagagcccgccggatcggcggttctttctgttctgcctcatcggcctgtcgggcgtggtggtgaacgaggcagtcctgagcctcctgtggtacgggttccacctgcgggacaccgtggcttccgtcgccgcttctttcgtggccatgttgaacaactatttttggaacgatcgcgtcacgtggaaatccgagtcctccggacgagggtggggatggaagctgcccgtgttcgtcggcatttcggtcgtcgggatcgccatcacgacgctcgtgatgcgaggatgcgagggctttggcgtgcccgttcccgctggacaggccatcggcatcctggtgtccacagcgtggtcgtattggatgaacagccgcgtgacttggcgaaacatcgatcgcgaagcgcgtggggatgcgattgtggtcacacgggagtcggtgcgggattcgctgatgcgggcgaaaacaggcgcgtga

SEQ ID NO: 272 - DNA, 1227 bp, Artificial
  Substituion in SEQ ID NO 257
gtgcgtggttccgcgatgatggacagggccaagcctcggatcggtaggccttggcgcaaggaggctttgtgcgtggacgtcagtgtggtgatcccgacttacaacgagcgagacaacatccatcccctggtggagcgcatccatcaagctttagcccctctggggatttcctacgagatctggtttgtcgatgacagcagcgacgatacggtcgcagtgcttcgagatctggaggcccgggatcccgccgttcacgtgttccaccgcgatcacgagcgtggcctcgcgagcgcggtcgtgcgtggattcgaaaaggcgcagggcaggtaccttgtcgtgatggacgctgacctgcagcatccgccggagattttgccggccatctacgagcgtttggagtccgggatcgacgtggtaatcccaagccgtttcgtggaagggggctcggacggcgggttgggcccgctgcgaaagctcatctcgtggaccgcgcgggtcattgggcaactcgcgctccatcgcctgcgcaagatctcggattgcacgagcggtttctttggcctgcggcgcgaagtgattgaaggcgtcgaactgaaccccattggatggaagatcttgatcgaggtgctggtgaaaggccgctatcgcagcgtgcatgagatcgcgtacgagttcgtggcccgcgacttcggcgaatcgaagatgagcctcaaggagcagtggaactactttcgccacctcgtgcgcctggtgagccagagcccgccggatcggcggttctttctgttctgcctcatcggcctgtcgggcgtggtggtgaacgaggcagtcctgagcctcctgtggtacgggttccacctgcgggacaccgtggcttccgtcgccgcttctttcgtggccatgttgaacaactatttttggaacgatcgcgtcacgtggaaatccgagtcctccggacgagggtggggatggaagctgcccgtgttcgtcggcatttcggtcgtcgggatcgccatcacgacgctcgtgatgcgaggatgcgagggctttggcgtgcccgttcccgctggacaggccatcggcatcctggtgtccacagcgtggtcgtattggatgaacagccgcgtgacttggcgaaacatcgagcgcgaagcgcgtggggatgcgattgtggtcacacgggagtcggtgcgggattcgctgatgcgggcgaaaacaggcgcgtga

SEQ ID NO: 273 - protein, 759 aa, Alicyclobacillus acidocaldarius
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 274 - DNA, 2280 bp, Alicyclobacillus acidocaldarius
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 275 - protein, 364 aa, Thermoanaerobacter tengcongensis MB4
LSLCLITKNEEKNISRCINSVKDIVDEIVVVDTGSTDRTIEIAKSFGAKVIQIKWEDDFSKARNTAIESATGDWILFLDADEEIKKEDVSKIKSLLYDDTVEAYLFKFVNYAGSSINSGLTEINYNYRLFRNNGKLKYIYPVHENLRNIEENRPPIAKKADVTILHYGYLADIRKEKNKSERYIKLISKYLESHPEDKFQHANLAVEYFNIGDYQKALKHLLIATKGMDVNSVNATRLLRYLIGCYIGLKDYSTALKIIKDAKDYYKDIPDFSFLEGLMYMDQKRYEKAIEAFKESLSIGEYDGLFITMGGTGSYRARYMIGLCKEKLNQLNDAVKEYIEVLKENPNYQEVFIKLFDLFIKNEP

SEQ ID NO: 276 - protein, 358 aa, Listeria welshimeri serovar 6b str. SLCC5334
LISICMIVKNEAHILRQSLASFRKFTEEIIIVDTGSTDETKEIAKEFTDFVYDFEWTGNFSDARNFAAKHATGKWILAIDADECLEEESYLQLKKQLKAPTEPIQMAQIISFTGEKGRVTTTNQMARVYKNDGTICFRGVIHEQLEGIDKHAVETGFAPVKIYHYGYMSEIVEKQGKSDRNLRLLEKEVKNNKNSGFVHFNIGQEMNRLGDKKEALKEFTKAFRLRDNNQYIWAKLSAYHISELLEQEKRYEESLAIIEEAKVIWPNVPEFPLKKANILYLHHQLEDAKEIYHSLLDNKVIDYQPIVLYEATNFMPHKMLGTIYLEEKDYTRAMTHFSKAYAENSSDYGVMFQMIMLL

SEQ ID NO: 277 - protein, 345 aa, Bacillus cereus subsp. cytotoxis NVH 391-98
ISACLIVKNEEDMLRKCLESLQGGVDEIVVVDTGSTDTTKEIAKEFTDKVYDFEWTNDFAEARNFAASKASGEWILAIDADECVDPKNLAAAIEEIQSHDNKFDVYAVEINSFSDKYGENLSMNHMQRIYKNNGEFHFSGAIHEQIVEKGEGRQELVFSALKLYHYGYLPNVVKKKNKRKRNMDILKKALKSNNNDGFTYFNYGQELRSLGKTKEALESFIKAYQNKEDVYEEWVSRCLYFIVEMLVELKRYEEAIVIINDAEEVFSTAPDFPFWKGEIYFKQKRFDDAKEVYTHIISNNMIYQNAVFNAGAKTFLPHVRLGEIYTQERQHQQALQHYVEALNEN

SEQ ID NO: 278 - protein, 358 aa, Listeria innocua Clip11262
LISICMIVKNEAHILRQSLASFRKFTEEIIIVDTGSTDDTKEIAKEFTDFVYDFEWTGNFSDARNFAAKHATGKWILAIDADECLEEESYRKLEKQLKSPIEPIQMAQIISFTGEKGRVTTTNQMARVYKNDGTICFRGVIHEQLEAVDKHAIEAGLAEVKIYHYGYMSEIVEKQDKSDRNLRLLEKEVKNNKNSGFVHFNIGQEMNRLGNKKEALKEFSEAFRLRDNNHYIWAKLSAYHISELLEQEKRYDESLAIIEEAKVIWPNVPEFPLKKANILYVNHQLEDAKEIYKSLLENTAIDYQPIVLYEATNFMPHKMLGTIYLEEKDYTRAMTHFSKAYAENSSDYGVMFQMIMLL

SEQ ID NO: 279 - protein, 358 aa, Listeria monocytogenes FSL N3-165
LISICMIVKNEAHILRQSLASFRKFTEEIIIVDTGSTDETKEIAQEFTDFVYDFEWTGNFSDARNFAAKHATGKWILAIDADECLEEESYRKLEKQLKSPTEPIQMAQIISFTGEKGRVTTTNQMARVYKNDGTICFRGVIHEQLEAIDKRPIAAGVAEVKIYHYGYMSEIVEKQDKSDRNLRLLEKEVKNNKNSGFVHFNIGQEMNRLGNKKEALKEFSEAFRLRDHNHYIWAKLSAYHIAELLEQEKRYDESLAIIEEARVIWPNVPEFPLKKANILYVNHQLEDAKEIYQSLLENAAIDYQPIVLYEATNFMPHKMLGTIYLEEKDYTRAMTHFSKAYAENSSDYGVMFQMIMLL

SEQ ID NO: 280 - protein, 759 aa, Artificial
  Substituion in SEQ ID NO 273
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDNPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 281 - protein, 759 aa, Artificial
  Substituion in SEQ ID NO 273
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAIWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 282 - protein, 759 aa, Artificial
  Substituion in SEQ ID NO 273
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLDGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 283 - protein, 759 aa, Artificial
  Substituion in SEQ ID NO 273
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGQIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLKALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 284 - protein, 759 aa, Artificial
  Substituion in SEQ ID NO 273
MRRIVVLLSACLIVKNEAHVLPRCLGSLQGVADEIVVVDTGSTDDTPRIAESFGARVYHFEWTGDFAVARNESLRYALGEYVLVIDADEFLPKEDGVRLRQALQERRADAYTVDLVNYLGSVARFVRSPGVRVVRVFRRGFSYMGSIHEQILYDVIAKGGNIEVLDVEIHHLGYLAEFVALKGKSDRNLEILNQALAIDPDNFFHITNLMAEYARLGDPKKVVELGERAYDLFQRGRVNQPHLVLRMYRMMIAAHGDLGNYDRVEALAREAELFFPNIPDVPFVHALYVMQRGDWRKAIRLFERSREIGEIRSEIIDTIAGAGSYVAAAKLGELWLLEGDVELAREYFVQSLRENLRQEGTFFFLASLLPLNDPSVFEQLRALASHDPVCLAYLALAGAVWRVDHAWRLINEIEQTPVTAPIVAKLRALGAVLGILPANDVRVDSTVEREIQWYEALFALERGDRDQAERCLRDQPERWERLSEWLTSKQGLCISPILDELLLARVDELLLAWLPRAEDRDLALSRVLASPLREEVWKAAWLGERGWECDFLALGAFRRRDIQASLNWLERGLTYEPTVRRAIVEIDLALCHKNIAHAQEVASQASRLFPESKLLEGIAGSLGVSPRPMRSLDDLLGGGSGLNPHRAYQSSVNSMPLKVKIMKLHERAVECVDQVKALVDQGDIMGARTYIQYVQDIITFLRSNLDTSTEAGKAADAAYAYFYKMLVEWFLQPSKVESEYKEMRDFWQSWADTWAKVEA

SEQ ID NO: 285 - DNA, 2280 bp, Artificial
  Substituion in SEQ ID NO 274
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgacaatccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 286 - DNA, 2280 bp, Artificial
  Substituion in SEQ ID NO 274
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcaatttggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 287 - DNA, 2280 bp, Artificial
  Substituion in SEQ ID NO 274
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgatggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 288 - DNA, 2280 bp, Artificial
  Substituion in SEQ ID NO 274
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtcaaatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactcaaagccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 289 - DNA, 2280 bp, Artificial
  Substituion in SEQ ID NO 274
gtgaggagaatcgtcgtgctactttcggcctgtctcatagtgaaaaacgaagctcatgtgctaccgcgttgcttaggttcgctccaaggcgtagcagatgaaatcgtggtagtagacacaggttctacggatgacactcctcgcatcgccgagtcattcggtgcgcgtgtgtatcattttgagtggactggagactttgcggtagcccgaaacgaatcgttgcgatatgcgctgggcgagtatgtgcttgtgatcgatgctgatgagtttttgccaaaggaggacggtgttcgcctgcgtcaggcgctccaagagaggcgggccgacgcttatactgtggacctcgtcaactacttaggatcagtggctcgttttgtccgttcacccggtgttcgcgtggtgcgcgtctttcgacgcggtttctcgtacatgggttctatccacgaacaaattttgtacgacgtgatcgccaaaggcggtaatatcgaggttcttgacgtcgagattcatcatttaggttatctagccgagttcgtagcgcttaaaggcaagtcggaccgcaatctcgagatcttaaatcaggccctggcaattgatccggataatttttttcatatcacgaaccttatggccgaatacgcccggttaggtgatccaaaaaaagtcgtggagctgggcgagcgcgcatacgacctttttcagcgcggtcgagttaaccagccgcatctcgttctgcgaatgtatcgcatgatgatcgcagcgcacggcgatcttggcaattatgaccgagtcgaggcactggcgagagaagccgagctattctttccgaatatcccggacgtcccattcgtccatgcactctatgtgatgcaacgcggcgattggcgaaaggcgattcggctgtttgagcgcagtcgtgaaattggtgagattcgatctgagattatcgacaccatagctggcgcgggctcatacgtcgcggctgcgaagctcggcgaactctggctactcgagggcgatgtagaacttgctcgagaatattttgtacagagtttacgtgagaacctgcgtcaggagggcaccttctttttcttagcttcgcttctcccgctgaatgatccaagcgtattcgagcaactccgtgccctcgcgagccacgatccagtctgtcttgcgtatcttgccctcgcaggagcagtatggcgggtcgaccatgcttggcggctcatcaatgaaatcgaacaaacgcccgtgacggcaccaatcgtcgcaaaactgcgcgcactcggcgcggtacttggtattctacccgcaaacgatgtccgagtggattcgacggtcgaacgggaaattcaatggtacgaggcgctctttgcacttgaacgaggagatcgcgaccaggcagagagatgcctacgcgaccaaccggagcgttgggagcgtctgtctgagtggctaacgagcaagcaaggtctttgcattagcccgatcctggacgagttgctgctagctcgtgtcgatgagttgcttcttgcgtggctaccaagggcagaagaccgagatctcgcgctgtcaagggttttggcgtctccgcttcgcgaggaagtctggaaggctgcgtggctcggcgaacgcggctgggagtgcgactttttggccttgggtgcgtttcggcgccgcgacattcaggcaagtctcaactggctcgagcgtggtctcacctacgagcccacagtacggcgggccatcgtcgagatcgatctcgccttatgccacaaaaacatcgctcacgcccaggaagtagcaagccaagcaagtaggttgttccctgaatcgaaactgttggagggcattgcagggagcctaggcgtctcgccgcgaccaatgcgctctttagacgacttgttgggagggggtagtggcttgaatccacatcgcgcctaccaatcgtccgtcaacagcatgccacttaaggtaaagatcatgaagctccatgagcgggccgtagagtgcgtcgatcaagtcaaggctctcgttgatcaaggtgacatcatgggggcccgcacgtacatccagtacgtgcaagacattatcacctttttgcgcagtaacctcgacacgtcgacggaagcaggcaaggcggccgatgcggcatacgcgtacttctataagatgctggttgagtggttcctgcagccatcgaaggtggaaagcgagtacaaggaaatgcgagatttctggcagtcgtgggcggacacgtgggccaaggttgaggcatga

SEQ ID NO: 290 - protein, 383 aa, Alicyclobacillus acidocaldarius
MVEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 291 - DNA, 1152 bp, Alicyclobacillus acidocaldarius
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 292 - protein, 376 aa, Bacillus sp. B14905
FVISQENWSLHRKGHQDQQRHMEKVKDAIKNNLPDLVSEESIVMSNGREVIKIPIRSLDEFKIRYNYDNSKHVGQGQGDSNVGDVVARDGSKANQTQGKGKEAGDKPGQDYYEAEVSLEEIQNVLFHELELPNLQQKEKAEIVTEKIEFNDIRKKGLMGNVDKKRTILNALKRNAMHGKAEITPIHNDDLRFKIWDEVVKPESKAVVLAMMDTSGSMGAFEKYCARSFFFWMTKFLRSKYETVEIEFIAHHTEAKVVTEEEFFTKGESGGTICSSAYKKALELIKEKYSPSRYNIYPVHFSDGENISMDNEKCLKLVAELMDVSSMFGYGEVNQHNRFSTLMYTYKKIDDPKFRHHILRKKGDVYDALKSFFKKNE

SEQ ID NO: 293 - protein, 376 aa, Bacillus halodurans C-125
FVVSQENWTLHRKGYQDQRRHQEKVKEAIRKNLPDLVSEENIIMSNGREVIKIPIRSLDEYKIRYNYDKNKHVGQGDGDSQVGDVIARDPSAGQQGPGKGQGAGDQPGEDYFEAEVSILELEELLFRELELPNLQQKEEDHLVVEHIEFNDIRKKGLMGNIDKRRTILSAIKRNALEGRPGLIPIYNDDLRFKTWNEVVRPESKAVVLAMMDTSGSMGRWEKYMARSFFFWMTRFLRTKYETVDIEFIAHHTEAKVVSEEDFFSKGESGGTICSSAYRKALELINEKYDPARYNIYPFHFSDGDNLTSDNARCLKLVHELMESSSMFGYGEVNQYSRHSTLMNAYKNLKDPRFRSYVLKEKGDVYRAMKTFFKKEE

SEQ ID NO: 294 - protein, 377 aa, Bacillus pumilus SAFR-032
QFIVSQEDWSLHRKGYDDQQRHQKKVKEAIKNNLPDLVTEESIIMSNGKDVVKIPIRSLDEYKIRYNYDKNKHVGQGDGDSEVGDIVARDGSDSKQGQGKGQSAGDQAGEDYYEAEVSLMDLEEALFRELELPNLKQKELDDIIVEQIEFNDIRKTGLTGNIHKKRTMLSAFKRNAMTGSPSFYPIYPEDIKYKTWNEVTKPESKAVVLAMMDTSGSMGLWEKYMARSFFFWMTRFLRTKYETVDIEFIAHHTEAKVVDEEHFFSRGESGGTICSSVYRKALELIDERYPPSRYNIYPFHFSDGDNLTSDNARCVKLVSEIMKKANLFCYGEVNQYNRHSTLMSAYKHIQDEKFKHYILKQKSDVFLALKKFFQQEE

SEQ ID NO: 295 - protein, 377 aa, Bacillus sp. NRRL B-14911
QFVISEEDWSLHRKGHDDQQRHQEKVQDAIRNNLPDLITEESIIMSNGREVVKIPIRSLDEYKIRYNYDKNKHVGQGDGDSQVGDVVARDGSSGQKGPGKGQGAGDQPGEDYFEAEVSMMELEEALFKQLELPNLKRKEQEEHLVENIEFNDIRKTGLMGNIDKKRTMMTAFKRNAMTGKPAFYPIYQEDLKFKTWNEIVKPDSKAVVLAMMDTSGSMGLWEKYMARSFFFWMTRFLRTKYETVEIEFIAHHTEAKVVSEEDFFSKGESGGTICSSAYRKALELINEKYNPRRFNIYPFHFSDGDNLTSDNARCVKLVEELIAVSSMFGYGEVNQYNRHSTLMSAYKNIKNEHFRYYILKQKADVFHAMKSFFQNEE

SEQ ID NO: 296 - protein, 374 aa, Paenibacillus larvae subsp. larvae BRL-230010
FIVSRENWSLHRKGYQDQTRHQQKIKDAIKQNLPDLVTEENIILSNGKQIIKIPIRSLDEYRFRFNYNKSKHVGQGDGDSQVGDVLGIDPYTQQGKGAGAGDQAGEDYYEAEVDMEELQSLLFEELELPYLNPKERLDISTQDIIFNDIRKKGIMSNIDKKRTILENIRRNASSGTPGIHGISPDDLRFKTWDEIEKPHSNALILAMMDTSGSMGSFEKYIARSFFFWMTRFLRSKYEHVDIVFIAHHTEARIVSEEEFFTKGESGGTICSSAYQAALDVIDRSYPPSKYNIYPFHFSDGDNLTSDNERCVKLIQRLMERSNMFGYGEVNQYNRSSTLMQTYRHIQDPKFLYYIIREKGEVYKALKTFFAKPEG

SEQ ID NO: 297 - protein, 383 aa, Artificial
  Substituion in SEQ ID NO 290
MVEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFKTYVIRDKSEIYGALRHFFSQQQGVKSA

SEQ ID NO: 298 - protein, 383 aa, Artificial
  Substituion in SEQ ID NO 290
MVEFTLQREDWSLHRKGHIDQERHREKVREAIREHLADLVSDESLIMSDGKQIIKIPIRSLEEYRIRYNFQKGKHVGSGSGDTAVGDLVARGKPEADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 299 - protein, 383 aa, Artificial
  Substituion in SEQ ID NO 290
MVEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYANVQIKYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 300 - protein, 383 aa, Artificial
  Substituion in SEQ ID NO 290
MVEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYANVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVRSA

SEQ ID NO: 301 - protein, 383 aa, Artificial
  Substituion in SEQ ID NO 290
MVEFTLQREDWSLHRKGHIDQERHREKVREAIREHLADLVSDESLIMSDGKQIIKIPIRSLEEYRIRYNFQKGKHVGSGSGDTAVGDLVARGKPDADGQPGPGQGEGAGSEPGVDYAEAEVTLEDIQQELFRELELPDLAEKDEADMVVDTVEFRDVRKKGITANIDKKRTLLQALRHAKKDDRVVITPDDLRYKTWETIVKPDSNAVILAMMDLSGSMGLFEKYCARTFFFWMTRFLRTKYAQVQIRYIAHHTEAHEVDEEYFFTKGESGGTICSSAYQYALDMVNREYPPERYNIYSIHFSDGDNLTSDNEKCVQLVKELSSVSRMFGYAEVNQYSRSSTLMSAYGKLQIPRFRTYVIRDKSEIYGALRHFFSQQQGVKSA

SEQ ID NO: 302 - DNA, 1152 bp, Artificial
  Substituion in SEQ ID NO 291
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttaaaacgtacgtgatacgagataaatccgagatctacggtgcgcttcgccacttcttttcccagcagcaaggggtgaagagcgcatga

SEQ ID NO: 303 - DNA, 1152 bp, Artificial
  Substituion in SEQ ID NO 291
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggaagccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 304 - DNA, 1152 bp, Artificial
  Substituion in SEQ ID NO 291
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattaaatacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 305 - DNA, 1152 bp, Artificial
  Substituion in SEQ ID NO 291
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgccaacgtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgcgtagcgcatga

SEQ ID NO: 306 - DNA, 1152 bp, Artificial
  Substituion in SEQ ID NO 291
gtggtcgaattcacacttcaacgcgaagactggtcactccaccgcaaagggcatatcgatcaagagcgccatcgcgaaaaggtgcgcgaggccattcgggaacatctcgccgatctcgtcagcgatgaaagcctgatcatgtcggacgggaagcagatcatcaagattcctatccggtcgcttgaggagtaccgcattcggtacaactttcagaaaggcaagcacgttggcagcggatccggtgacacggccgtgggcgatctcgtcgcccgcggcaagccggacgccgacggacagcccggtccgggtcagggcgagggcgccggatcggagccgggggtcgactacgccgaggcggaggtgacgctggaggacatccagcaggagctgttccgggagctcgaacttcccgatctcgccgaaaaggacgaggcggacatggtcgtggacaccgtggaatttcgcgacgtccgcaagaagggcatcacggccaacatcgacaagaaacggaccttgcttcaggcccttcgccacgccaagaaggacgatcgcgtcgtgatcacgccggacgatctgcgctacaagacatgggagaccatcgtcaagccagattcgaacgcggtcatcctcgcgatgatggatctgtcgggatcgatgggcctgttcgagaagtactgcgcaaggaccttcttcttttggatgacgcggtttctgcgcacgaagtacgcccaagtccagattcggtacatcgcccatcataccgaggcgcatgaggtcgacgaggagtactttttcacaaagggcgagagcgggggtaccatctgttcgtccgcgtatcagtatgcgctcgacatggtgaaccgggagtatccgcccgagcggtacaacatttattccatccacttttcggacggcgacaacctgacgtcggacaatgaaaaatgtgtgcagttggtgaaggaactttccagcgtttcgcgcatgtttggctacgcagaggtgaaccaatactcgcgttcgtcgacgttgatgagtgcatacgggaagctccagattcctcgatttcgcacgtacgtgatacgagataaatccgagatctacggtgcgcttcgccacttcttttcccagcagcaaggggtgaagagcgcatga

SEQ ID NO: 307 - protein, 959 aa, Alicyclobacillus acidocaldarius
MKRPWSAALAALIALGTGASPAWAAAHPSPKVPAGAAGRVRAADVVSTPISMEIQVIHDALTVPELAAVQAAAQAASNLSTSQWLQWLYPNATPTTSAQSQAAQAVANLFNLATYGAVSTRGSNAAQILQTLQSISPLLSPRAVGLFYQSFLTEIGQSSKAILARQASSSIVGNALAQAASLSPTISAYLRQNGLSPSDLARTWSSFETQVDPQGAAQTALATRICTNALGFGAPTASATITVNTAARLRTVPATAFGLNAAVWDSGLNSQTVISEVQALHPALIRWPGGSISDVYNWETNTRNDGGYVNPNDTFDNFMQFVNAVGASPIITVNYGTGTPQLAADWVKYADVTHHDNVLYWEIGNEIYGNGYYNGNGWEADDHAVPNQPQKGNPGLSPQAYAQNALQFIQAMRAVDPNIKIGAVLTMPYNWPWGATVNGNDDWNTVVLKALGPYIDFVDVHWYPETPGQETDAGLLADTDQIPAMVAELKREINAYAGSNAKNIQIFVTETNSVSYNPGQQSTNLPEALFLADDLAGFVQAGAANVDWWDLLNGAEDNYTSPSLYGQNLFGDYGLLSSGQATPKGVQEPPQYTPLPPYYGFQLVSDFARPGDTLLGSASSQSDIDVHAVREPNGDIALMLVNRSPSTIYSADLNVLGVGPYAITKALVYGEGSSAVSPALTLPTAHSVKLMPYSGVDLVLHPLIPAPHAAASVTDTLALSSPTVTAGGSETVTASFSSDRPVRDATVELELYDSTGDLVANHEMTGVDIAPGQPVSESWTFAAPAANGTYTVEAFAFDPATGATYDADTTGATITVNQPPAAKYGDIVTKNTVITVNGTTYTVPAPDASGHYPSGTNISIAPGDTVTIQTTFANVSSTDALQNGLIDMEVDGQNGAIFQKYWPSTTLLPGQTETVTATWQVPSSVSAGTYPLNFQAFDTSNWTGNCYFTNGGVVNFVVN

SEQ ID NO: 308 - protein, 959 aa, Alicyclobacillus acidocaldarius; identical to SEQ ID NO: 307
  CARBOHYD (174)..(174)
  CARBOHYD (193)..(193)
  CARBOHYD (297)..(297)
  CARBOHYD (393)..(393)
  CARBOHYD (404)..(404)

SEQ ID NO: 309 - protein, 378 aa, Alicyclobacillus acidocaldarius
MKVALVHDWLVDFAGSERVLFELAKLFPDAPIYTSVYSERALANVFPKERVRTSFLQKIPLSVKRYRSLLPFLPFAFEMFDLTGYDVIISSSHACAKGVVAGSNSIHICYCHTPMRYAWSHYHQYLRGVRGTLKRATVGAILSWLRTWDFIAAQRVDFFIANSSEVQKRIRHYYRRDAVVIHPPISAPEGENGDPERADFYLYLGRLVEYKRVDLLVDAFRHLPSARLIVAGDGPEMNRLRRSAPLNVEFAGKVTEDEKWDLLRRAKALLFPAHEDFGIVIGEARAVGTPVIGLAQGGVLDYAGDPGVLPWIKRQNLDDVKMAVDRFERESFNSDVYEKYLIQTEDSFRNAVARLVDDLVANKKGESRVGRAADARDH

SEQ ID NO: 310 - DNA, 1137 bp, Alicyclobacillus acidocaldarius
gtgaaggtggcattggtccacgactggctagttgatttcgcgggatcagaacgagttttgtttgaacttgcgaagttgttcccagatgcgccaatctatacgtctgtctatagcgaacgtgctctcgccaatgtgtttccgaaggaacgtgtgcgcacaagttttttgcagaagataccgttgtcagtcaagcgctatcggtcattgttgccgttcctaccatttgccttcgaaatgttcgatttgacggggtatgatgtcatcatctcgagttcacacgcatgtgccaaaggcgtcgttgctggatcgaatagtattcatatctgttattgtcatacgccgatgcgatacgcgtggagtcactatcatcagtacctgagaggcgttcgcggaacgctcaaacgggctaccgtcggagccatcctttcatggttgagaacatgggattttatagctgctcaaagagttgatttcttcattgcgaattcttctgaagtccagaaacgaatccggcattactatcgtagagacgccgttgtgatccatccgcctatttcagctcctgaaggcgaaaacggcgatccagagagagcagatttctatttgtatctgggtcgtttagtcgagtataagcgggtggacttgcttgtggacgcttttcgccacctgccgtctgcaagattgattgtggcaggagatggaccagagatgaatcgccttcgccgttcagctccgctcaacgtagagttcgcagggaaggtcacagaagatgaaaaatgggatctgttgaggcgggcgaaggctttgttgtttccagcacacgaggattttggtatcgtgattggggaagccagagcagttgggacgcccgtgatcggacttgcacaagggggcgttttggactacgcaggcgatcctggtgtgctcccctggattaaaaggcaaaacctagacgatgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgcagcggatgcgcgagatcattga

SEQ ID NO: 311 - protein, 362 aa, Thermoanaerobacter sp. X514
MKIAIIHDWLTNMGGAERVILAFHEIFPDAPIYTSVYNPDKLPEEFRKMDIRTSFIQKLPKAKTKYNIYLPLMPVAFEQFDLSEYDVVLSSSSSCAKGVITRADTLHICYCHTPMRYAWDFYHEYKQNAPKWQRKFIPFLMNYIRMWDRLSADRVDYFIANSSAVARRIKKHYRRDAVVINPPVDTNFYTPKDEDEDYFLIVSRLVEYKRIDIAIEAFNDLGLPLIIIGDGPERSKLQKMAKSNIRFLGRLPDEEVKEYYAKCRAFIFPGEEDFGITPLEAQASGRPVIAFGKGGVLDSVIDGLTGIFFKDQNKESLKEAIKRFEKIDFSKETIRKHAEKFDVKIFKKKIYDFIINKYNDYR

SEQ ID NO: 312 - protein, 374 aa, Caldicellulosiruptor saccharolyticus DSM 8903
MKVAIVHEWLTTMGGSEKVILELKKLFPEAPIYTLVYNRRKLGKYFDKYLIITSNLQKNPLAHIKHQLFFKYMPRAFENFDLSDFDLVISSSSAFAKGVITSPNSVHICYCHTPPRYLWDLTHEYLKDYNLIIRRYLERNFHYLRIWDTIAANRVDYFVANSNYVANRIKKFYKRDCKVIYPPVDTEYFTPAKDKNIEDYYLIVSRLVPYKRVDLAVEAFNQLSKRLVIVGDGPEYKKLKSIAKSNIEFLGYQPDKTVRDLYQRCKALIFPGVEDFGIVPVEVQACGRPVIALKKGGAVETVEEGKTGVFFEKQDVESLKEAVYKFEQDIERFDKDYIRSHAEKFSAERFRMEFKDFILKVTEYERGEGMGGKV

SEQ ID NO: 313 - protein, 357 aa, Mesorhizobium sp. BNC1
VRVAIVHYWLVSMRGGEKVVEAFCDMYPDADIFTLVYDERKVSEKIRRHKVTTSFLQKIPGAVKHYQSLLPLMPFALESFDLSGYDLILSSESGPAKGIVPGPQAVHICYCHSPMRYLWDHYHFYRANSGMLARALLTMMAPPLRAWDVSTSARVDHFVANSRHVADRIEKYYRRSATVLSPPVSVHEFAPTAATKDFFLLAGQLVGYKRADLAVEAFTKMGENLVVIGEGSEMDKLRRIAGPTVSFLGRAPFPLLKEMLARCRALVFPGEEDFGIVPVEAMASGRPVIAYGRGGALDSVSPGRTGILFHEQTVPSLIEAVRRFQSMERTFRPDVIRDHAAQFSEANFKARMQQIID

SEQ ID NO: 314 - protein, 363 aa, Dictyoglomus turgidum DSM 6724
MRVAVVHDWIVNIGGAEKVLKAILELFPDADVYTLVYLKDTLRKLGINNKVYSSFISGLPFAKTKYSYYLPLMPLAIEQFDLSKYDLVISSSHCVAKGVLTKSYQIHICYCHTPMRYIWDLYFPYLKEHKLENGIKGIFVKPILHYLRIWDVSSANRVDYFVANSQNVANRIRKIYRRDSVVIYPPVDVERFLPSYKKEDYFMVLSRLVPYKKVDLVVETFNELNLPLVVIGDGEEMGKIKKMAKENIKILGWQEDDVVKEYLAKAQALIFASEEDFGIVSVEAQACGTPVIAYNRGGAKETVIDGETGILFEEQNVESLKKAVLRFLKERDNFQRDKIMENAKRFSEDRFKREFKSYIEGII

SEQ ID NO: 315 - protein, 336 aa, Desulfotomaculum reducens MI-1
MKTAFIHDWLVTYAGAERVLEQMLKIFPDADLYSVVDFIPYNQRSFLQEKLSQTSFIQKLPFAKKKYRSYLPLMPLAVEQLDLSAYDLIISNSHAVAKGVITGPDQLHLSYVNSPMRYAWDLQHQYLQEAKLNRGLKGWTAKVLLHYLRMWDIRTANGVDSFTANSCFISRRIWKVYHREAKVIYPPVAVDEFDVGEYKEDFYLTISRMVPYKKMDLIVEAFSQRPDKNLIVIGDGPDFNKVKAKAKSNVTLLGYQPFDQLKDYMQRAKAFVFAAEEDFGITPVEAQACGTPVIAFGRGGALETIRGLDNPSPTGVFFRQQTVESLLSAVDLFERE

SEQ ID NO: 316 - protein, 378 aa, Artificial
  Substituion in SEQ ID NO 309
MKVALVHDWLVDFAGSERVLFELAKLFPDAPIYTSVYSERALANVFPKERVRTSFLQKIPLSVKRYRSLLPFLPFAFEMFDLTGYDVIISSSHACAKGVVAGSNSIHICYCHTPMRYAWSHYHQYLRGVRGTLKRATVGAILSWLRTWDFIAAQRVDFFIANSSEVQKRIRHYYRRDAVVIHPPISAPEGENGDPERADFYLYLGRLVEYKRVDLLVDAFRHLPSARLIVAGDGPEMNRLRRSAPLNVEFAGKVTEDEKWDLLRRAKALLFPAHEDFGIVIGEARAVGTPVIGLAQGGVLDYAGDPGVLPWIKRQNLEDVKMAVDRFERESFNSDVYEKYLIQTEDSFRNAVARLVDDLVANKKGESRVGRAADARDH

SEQ ID NO: 317 - protein, 378 aa, Artificial
  Substituion in SEQ ID NO 309
MKVALVHDWLVDFAGSERVLFELAKLFPDAPIYTSVYSERALANVFPKERVRTSFLQKIPLSVKRYRSLLPFLPFAFEMFDLTGYDVIISSSHACAKGVVAGSNSIHICYCHTPMRYAWSHYHQYLRGVRGTLKRATVGAILSWLRTWDFIAAQRVDFFIANSSEVQKRIRHYYRRDAVVIHPPISAPEGENGDPERADFYLYLGRLVEYKRVDLLVDAFRHLPSARLIVAGDGPEMNRLRRSAPLNVEFAGKVTEDEKWDLLRRAKALLFPAHEDFGIVIGEARAVGTPVIGLAQGGVLDYAGDPGVLPWIKRQNLDDVKMAVDRFERESFNSDIYEKYLIQTEDSFRNAVARLVDDLVANKKGESRVGRAADARDH

SEQ ID NO: 318 - protein, 378 aa, Artificial
  Substituion in SEQ ID NO 309
MKVALVHDWLVDFAGSERVLFELAKLFPDAPIYTSVYSERALANVFPKERVRTSFLQKIPLSVKRYRSLLPFLPFAFEMFDLTGYDVIISSSHACAKGVVAGSNSIHICYCHTPMRYAWSHYHQYLRGVRGTLKRATVGAILSWLRTWDFIAAQRVDFFIANSSEVNKRIRHYYRRDAVVIHPPISAPEGENGDPERADFYLYLGRLVEYKRVDLLVDAFRHLPSARLIVAGDGPEMNRLRRSAPLNVEFAGKVTEDEKWDLLRRAKALLFPAHEDFGIVIGEARAVGTPVIGLAQGGVLDYAGDPGVLPWIKRQNLDDVKMAVDRFERESFNSDVYEKYLIQTEDSFRNAVARLVDDLVANKKGESRVGRAADARDH

SEQ ID NO: 319 - protein, 378 aa, Artificial
  Substituion in SEQ ID NO 309
MKVALVHDWLVDFAGSERVLFELAKLFPDAPIYTSVYSERALANVFPKERVRTSFLQKIPLSVKRYRSLLPFLPFAFEMFDLTGYDVIISSSHACAKGVVAGSNSIHICYCHTPMRYAWSHYHQYLRGIRGTLKRATVGAILSWLRTWDFIAAQRVDFFIANSSEVQKRIRHYYRRDAVVIHPPISAPEGENGDPERADFYLYLGRLVEYKRVDLLVDAFRHLPSARLIVAGDGPEMNRLRRSAPLNVEFAGKVTEDEKWDLLRRAKALLFPAHEDFGIVIGEARAVGTPVIGLAQGGVLDYAGDPGVLPWIKRQNLDDVKMAVDRFERESFNSDVYEKYLIQTEDSFRNAVARLVDDLVANKKGESRVGRAADARDH

SEQ ID NO: 320 - protein, 378 aa, Artificial
  Substituion in SEQ ID NO 309
MKVALVHDWLVDFAGSERVLFELAKLFPDAPIYTSVYSERALANVFPKERVRTSFLQKIPLSVKRYRSLLPFLPFAFEMFDLTGYDVIISSSHACAKGVVAGSNSIHICYCHTPMRYAWSHYHQYLRGVRGTLKKATVGAILSWLRTWDFIAAQRVDFFIANSSEVQKRIRHYYRRDAVVIHPPISAPEGENGDPERADFYLYLGRLVEYKRVDLLVDAFRHLPSARLIVAGDGPEMNRLRRSAPLNVEFAGKVTEDEKWDLLRRAKALLFPAHEDFGIVIGEARAVGTPVIGLAQGGVLDYAGDPGVLPWIKRQNLDDVKMAVDRFERESFNSDVYEKYLIQTEDSFRNAVARLVDDLVANKKGESRVGRAADARDH

SEQ ID NO: 321 - DNA, 1137 bp, Artificial
  Substituion in SEQ ID NO 310
gtgaaggtggcattggtccacgactggctagttgatttcgcgggatcagaacgagttttgtttgaacttgcgaagttgttcccagatgcgccaatctatacgtctgtctatagcgaacgtgctctcgccaatgtgtttccgaaggaacgtgtgcgcacaagttttttgcagaagataccgttgtcagtcaagcgctatcggtcattgttgccgttcctaccatttgccttcgaaatgttcgatttgacggggtatgatgtcatcatctcgagttcacacgcatgtgccaaaggcgtcgttgctggatcgaatagtattcatatctgttattgtcatacgccgatgcgatacgcgtggagtcactatcatcagtacctgagaggcgttcgcggaacgctcaaacgggctaccgtcggagccatcctttcatggttgagaacatgggattttatagctgctcaaagagttgatttcttcattgcgaattcttctgaagtccagaaacgaatccggcattactatcgtagagacgccgttgtgatccatccgcctatttcagctcctgaaggcgaaaacggcgatccagagagagcagatttctatttgtatctgggtcgtttagtcgagtataagcgggtggacttgcttgtggacgcttttcgccacctgccgtctgcaagattgattgtggcaggagatggaccagagatgaatcgccttcgccgttcagctccgctcaacgtagagttcgcagggaaggtcacagaagatgaaaaatgggatctgttgaggcgggcgaaggctttgttgtttccagcacacgaggattttggtatcgtgattggggaagccagagcagttgggacgcccgtgatcggacttgcacaagggggcgttttggactacgcaggcgatcctggtgtgctcccctggattaaaaggcaaaacctagaagatgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgcagcggatgcgcgagatcattga

SEQ ID NO: 322 - DNA, 1137 bp, Artificial
  Substituion in SEQ ID NO 310
gtgaaggtggcattggtccacgactggctagttgatttcgcgggatcagaacgagttttgtttgaacttgcgaagttgttcccagatgcgccaatctatacgtctgtctatagcgaacgtgctctcgccaatgtgtttccgaaggaacgtgtgcgcacaagttttttgcagaagataccgttgtcagtcaagcgctatcggtcattgttgccgttcctaccatttgccttcgaaatgttcgatttgacggggtatgatgtcatcatctcgagttcacacgcatgtgccaaaggcgtcgttgctggatcgaatagtattcatatctgttattgtcatacgccgatgcgatacgcgtggagtcactatcatcagtacctgagaggcgttcgcggaacgctcaaacgggctaccgtcggagccatcctttcatggttgagaacatgggattttatagctgctcaaagagttgatttcttcattgcgaattcttctgaagtccagaaacgaatccggcattactatcgtagagacgccgttgtgatccatccgcctatttcagctcctgaaggcgaaaacggcgatccagagagagcagatttctatttgtatctgggtcgtttagtcgagtataagcgggtggacttgcttgtggacgcttttcgccacctgccgtctgcaagattgattgtggcaggagatggaccagagatgaatcgccttcgccgttcagctccgctcaacgtagagttcgcagggaaggtcacagaagatgaaaaatgggatctgttgaggcgggcgaaggctttgttgtttccagcacacgaggattttggtatcgtgattggggaagccagagcagttgggacgcccgtgatcggacttgcacaagggggcgttttggactacgcaggcgatcctggtgtgctcccctggattaaaaggcaaaacctagacgatgttaaaatggccgtcgaccgatttgaaagggaatccttcaattcggatatttacgagaagtacctcattcaaaccgaggatagttttcgaaacgccgtcgccaggcttgttgacgatttggtggcgaacaagaaaggtgagtcgcgtgttgggcgtgcagcggatgcgcgagatcattga

SEQ ID NO: 323 - DNA, 1137 bp, Artificial
  Substituion in SEQ ID NO 310
gtgaaggtggcattggtccacgactggctagttgatttcgcgggatcagaacgagttttgtttgaacttgcgaagttgttcccagatgcgccaatctatacgtctgtctatagcgaacgtgctctcgccaatgtgtttccgaaggaacgtgtgcgcacaagttttttgcagaagataccgttgtcagtcaagcgctatcggtcattgttgccgttcctaccatttgccttcgaaatgttcgatttgacggggtatgatgtcatcatctcgagttcacacgcatgtgccaaaggcgtcgttgctggatcgaatagtattcatatctgttattgtcatacgccgatgcgatacgcgtggagtcactatcatcagtacctgagaggcgttcgcggaacgctcaaacgggctaccgtcggagccatcctttcatggttgagaacatgggattttatagctgctcaaagagttgatttcttcattgcgaattcttctgaagtcaataaacgaatccggcattactatcgtagagacgccgttgtgatccatccgcctatttcagctcctgaaggcgaaaacggcgatccagagagagcagatttctatttgtatctgggtcgtttagtcgagtataagcgggtggacttgcttgtggacgcttttcgccacctgccgtctgcaagattgattgtggcaggagatggaccagagatgaatcgccttcgccgttcagctccgctcaacgtagagttcgcagggaaggtcacagaagatgaaaaatgggatctgttgaggcgggcgaaggctttgttgtttccagcacacgaggattttggtatcgtgattggggaagccagagcagttgggacgcccgtgatcggacttgcacaagggggcgttttggactacgcaggcgatcctggtgtgctcccctggattaaaaggcaaaacctagacgatgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgcagcggatgcgcgagatcattga

SEQ ID NO: 324 - DNA, 1137 bp, Artificial
  Substituion in SEQ ID NO 310
gtgaaggtggcattggtccacgactggctagttgatttcgcgggatcagaacgagttttgtttgaacttgcgaagttgttcccagatgcgccaatctatacgtctgtctatagcgaacgtgctctcgccaatgtgtttccgaaggaacgtgtgcgcacaagttttttgcagaagataccgttgtcagtcaagcgctatcggtcattgttgccgttcctaccatttgccttcgaaatgttcgatttgacggggtatgatgtcatcatctcgagttcacacgcatgtgccaaaggcgtcgttgctggatcgaatagtattcatatctgttattgtcatacgccgatgcgatacgcgtggagtcactatcatcagtacctgagaggcattcgcggaacgctcaaacgggctaccgtcggagccatcctttcatggttgagaacatgggattttatagctgctcaaagagttgatttcttcattgcgaattcttctgaagtccagaaacgaatccggcattactatcgtagagacgccgttgtgatccatccgcctatttcagctcctgaaggcgaaaacggcgatccagagagagcagatttctatttgtatctgggtcgtttagtcgagtataagcgggtggacttgcttgtggacgcttttcgccacctgccgtctgcaagattgattgtggcaggagatggaccagagatgaatcgccttcgccgttcagctccgctcaacgtagagttcgcagggaaggtcacagaagatgaaaaatgggatctgttgaggcgggcgaaggctttgttgtttccagcacacgaggattttggtatcgtgattggggaagccagagcagttgggacgcccgtgatcggacttgcacaagggggcgttttggactacgcaggcgatcctggtgtgctcccctggattaaaaggcaaaacctagacgatgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgcagcggatgcgcgagatcattga

SEQ ID NO: 325 - DNA, 1137 bp, Artificial
  Substituion in SEQ ID NO 310
gtgaaggtggcattggtccacgactggctagttgatttcgcgggatcagaacgagttttgtttgaacttgcgaagttgttcccagatgcgccaatctatacgtctgtctatagcgaacgtgctctcgccaatgtgtttccgaaggaacgtgtgcgcacaagttttttgcagaagataccgttgtcagtcaagcgctatcggtcattgttgccgttcctaccatttgccttcgaaatgttcgatttgacggggtatgatgtcatcatctcgagttcacacgcatgtgccaaaggcgtcgttgctggatcgaatagtattcatatctgttattgtcatacgccgatgcgatacgcgtggagtcactatcatcagtacctgagaggcgttcgcggaacgctcaaaaaagctaccgtcggagccatcctttcatggttgagaacatgggattttatagctgctcaaagagttgatttcttcattgcgaattcttctgaagtccagaaacgaatccggcattactatcgtagagacgccgttgtgatccatccgcctatttcagctcctgaaggcgaaaacggcgatccagagagagcagatttctatttgtatctgggtcgtttagtcgagtataagcgggtggacttgcttgtggacgcttttcgccacctgccgtctgcaagattgattgtggcaggagatggaccagagatgaatcgccttcgccgttcagctccgctcaacgtagagttcgcagggaaggtcacagaagatgaaaaatgggatctgttgaggcgggcgaaggctttgttgtttccagcacacgaggattttggtatcgtgattggggaagccagagcagttgggacgcccgtgatcggacttgcacaagggggcgttttggactacgcaggcgatcctggtgtgctcccctggattaaaaggcaaaacctagacgatgttaaaatggccgtcgaccgatttgaaagggaatccttcaattcggatgtctacgagaagtacctcattcaaaccgaggatagttttcgaaacgccgtcgccaggcttgttgacgatttggtggcgaacaagaaaggtgagtcgcgtgttgggcgtgcagcggatgcgcgagatcattga

SEQ ID NO: 326 - protein, 13 aa, Alicyclobacillus acidocaldarius
DVVSTPISMEIQV

SEQ ID NO: 327 - protein, 86 aa, Alicyclobacillus acidocaldarius
QASSSIVGNALAQAASLSPTISAYLRQNGLSPSDLARTWSSYYCTQFDDPQGAAQTALATRICNDQALGGGAPTASATITVNTAAR

SEQ ID NO: 328 - protein, 47 aa, Alicyclobacillus acidocaldarius
GLNAAVWDSGLNSQTVISEVQALHPALIRWPGGSISDMDYNWETNTR

SEQ ID NO: 329 - protein, 39 aa, Alicyclobacillus acidocaldarius
EADDHAVPNQPQKGNPGLSPQAYAQNALQFMQSPVVYYR

SEQ ID NO: 330 - protein, 959 aa, Alicyclobacillus acidocaldarius; identical to SEQ ID NO: 307

SEQ ID NO: 331 - protein, 537 aa, Alicyclobacillus acidocaldarius
MPSRVPKSIFYNQVGYLISGDKRFWIQAHEPQPFALRTPEGQAVFAGMTKPVGGNWYVGDFTALRVPGTYTLTVGTLEARVVIHRRAYRDVLEAMLRFFDYQLCGVVLPEDEAGPWAHGACHTSDAKVFGTERALACPGGWHDAGDYGKYTVPAAKAVADLLLAHEYFPAALAHVRPMRSVHRAPHLPPALEVAREEIAWLLTMQDPATGGVYHKVTTPSFPPLDTRPEDDDAPLVLSPISYAATATFCAAMAHAALVYRPFDPALSSCCADAARRAYAWLGAHEMQPFHNPDGILTGEYGDAELRDELLWASCALLRMTGDSAWARVCEPLLDLDLPWELGWADVALYGVMDYLRTPRAAVSDDVRNKVKSRLLRELDALAAMAESHPFGIPMRDDDFIWGSNMVLLNRAMAFLLAEGVGVLHPAAHTVAQRAADYLFGANPLGQCYVTGFGQRPVRHPHHRPSVADDVDHPVPGMVVGGPNRHLQDEIARAQLAGRPAMEAYIDHQDSYSTNEVAVYWNSPAVFVIAALLEARGR

SEQ ID NO: 332 - DNA, 1614 bp, Alicyclobacillus acidocaldarius
atgccgtctcgcgtgcccaaatcgattttttataatcaagttgggtatctgatcagcggcgacaagcgcttttggattcaggctcacgagcctcagcctttcgcgctgcgcacgccggaagggcaggccgtgttcgcgggaatgacgaagcccgtcggcgggaattggtacgtcggcgattttaccgcgcttcgcgtgccggggacctacacgttgacggtagggactctcgaggcgcgggtcgttatccatcgccgcgcgtatcgtgacgtgctcgaggccatgctgcgcttcttcgactatcagctctgcggcgtcgtgctgcccgaggatgaagccgggccgtgggcgcacggcgcctgtcacacgagcgacgccaaggtgtttggcaccgagcgcgccttggcctgcccaggcggttggcacgacgctggcgattacggcaaatacacggtccccgccgccaaggccgtggccgatctcctgctcgcccacgagtacttcccggcggcactggcgcacgtccgccccatgcgctcggtgcatcgggcgcctcatctgccgccggcgctcgaggtggcgcgcgaggagattgcctggcttctcaccatgcaggatcccgcgacaggcggcgtgtaccacaaagtcaccacgccttcctttccgccgctcgacacgcgccccgaagacgacgatgcgcccctcgtcctcagtcccatctcctacgccgccacggccacgttttgcgccgccatggcgcatgccgccctggtgtaccgccctttcgatccggccctatcctcgtgctgtgcggacgccgcccgtcgcgcgtacgcgtggctcggcgcgcacgagatgcagccgtttcacaatcccgatgggatcctcacgggcgaatacggcgacgcggaactccgcgacgagctgttgtgggcgtcctgcgccctgcttcgcatgaccggcgattccgcgtgggcacgcgtgtgcgagccgcttctcgatctcgacctcccgtgggagttgggatgggcggacgtcgcactctacggcgtcatggattacctgcgcactccgcgcgccgccgtatcggacgacgtgcgaaacaaggtgaaaagccgccttctccgagaactcgacgccctcgccgcgatggctgagtcgcatccgttcggcattcccatgcgggatgacgatttcatctggggcagcaacatggtgctcttgaaccgcgccatggcgttcctgctggccgaaggcgtcggtgtccttcatcccgctgcacatacggtggcccagcgcgcggcggactacctgtttggcgcaaatccgctcgggcagtgctacgtcacgggctttggccaacgccccgtgcgccatccgcatcatcgcccgtccgtcgcggatgatgtggaccatcccgtccctggcatggtcgtcggcggcccaaaccgccacctgcaggacgagatcgcccgcgcacagcttgcggggagacctgcgatggaggcgtacatcgatcaccaggacagctactcgaccaacgaggtcgccgtctactggaattcgcctgccgtgtttgtcatcgcggctttgctcgaggcgcgcgggaggtga

SEQ ID NO: 333 - protein, 205 aa, Alicyclobacillus acidocaldarius
MKEDLRLQRQTPEPSSPPRHLAITFDDGPDGDMTPKILSTLRDYGVPATFFCIGQQVERFPDVLKSIHQAGHEIGNHTMTHPYLTKLTDAEIERELRECQAAIEKVVQVPIRYFRPPYGDIDDRVRRIAASLHYEVVLWDVDSLDWSGIPGPAVAANVLPKLRPGAIILMHAGPFAKGTPEALPYVLEVAVAMGYDFVPLAKLHR

SEQ ID NO: 334 - DNA, 618 bp, Alicyclobacillus acidocaldarius
gtgaaggaggaccttcgcttgcagcgccaaacgcccgaaccctcgtcgcccccgcgtcacctcgccatcaccttcgacgacggcccagacggggacatgacgcccaagatcctgtccacgctccgggattacggcgtgcccgccacctttttctgcatcggccagcaagtcgaacgatttcccgatgtcctcaaatccatccaccaggccgggcacgagatcggcaaccacaccatgacccatccctacctcacgaaattgacggacgccgagatcgaacgggaattgcgcgaatgccaagcggccattgagaaggtcgtgcaggtgcccatccgctactttcgcccgccgtacggagacatcgacgatcgcgtccgccgcatcgcggcctcccttcactacgaagtcgtcctctgggacgtcgactcgctcgattggtctgggattcccggcccagccgtcgcggccaacgtgctgcccaagctcaggccgggcgccatcatcctgatgcacgccgggccgtttgcgaagggtacgccggaggcgctcccgtacgtgctcgaggtggcggtggcaatgggctacgatttcgtcccgctcgcgaagcttcaccggtga

SEQ ID NO: 335 - protein, 688 aa, Alicyclobacillus acidocaldarius
MAKHAPIFPNVQGFLHGGDYNPDQWLAYPDVLEQDVQLMREAKWNVVSLGIFSWVSLEPEEGLFTFEWLDEAIERLTHAGVRILLATPSGARPAWLSAKYPEVLRVGPDGRRNRHGGRHNHCYTSPIYREKVRIINRKLAERYAHHPGVIGWHVSNEYGGECHCPLCQEAFREWLKRKYKTLDALNHAWWTPFWSHTYTDWSQIESPMPHGETSIHGLNLDWKRFVTDQTVDFCRHEIEPLKQVNPNLPVTTNFMGTYPGLNYWRFRDVLDVISWDSYPRWHAHETLVPEAVHTAMVHDLNRSILKKPFLLMESTPSVTNWQAVSKQKRPGVHVLVSLQAVAHGADSVQYFQWRKSRGSYEKFHGAVVDHVGHANTRVFRDVQAVGEMLERLAPMAGAEVKADAAVIFDWENRWALEDAKGPRNIGMHYEETVVNHYAALWRMGVPMDVIDEEQPLDGYKLVVAPMLYMVRPGVAERMKAFVERGGSLVLTYWSGIVDENDLVFLGGFPGPLRELAGVWAEEIDALYDGERVPVRVADGNPLGLAGHYEARELCEVVHLEGAEPIAVYGADYYEGMPAATVHRVGKGKVYYVAARLEDAFLRDFFARVAAEAGVARAIERELPDGVSAMVRSGDGVEYVMLMNFTPEAREVALDEAEYKPLYGEAPTDGAVRLPAYGVSVLERPARNG

SEQ ID NO: 336 - DNA, 2067 bp, Alicyclobacillus acidocaldarius
gtggccaagcacgcacccattttcccgaacgttcaaggttttttgcacggaggcgattacaaccccgatcagtggctggcgtatccggatgtcctcgaacaggatgtccagctgatgcgcgaagcgaagtggaacgtcgtctctctgggcatcttctcctgggtgagcctggagcccgaggagggcttgttcacgtttgaatggctcgacgaggccatcgaacgtctgacgcatgcgggcgtgcggattctgctcgccacgccgagcggcgcgcggcccgcctggctatccgccaaataccccgaagtccttcgcgtcggacccgacgggcggcgcaaccggcacggcggccgccacaaccactgctacacgtcgcccatctaccgcgagaaggtgcggatcatcaaccggaagctggcggagcggtacgcccatcatccgggcgtgatcggctggcacgtgtcgaacgagtacggcggcgagtgccactgcccgctgtgccaggaggcgtttcgcgagtggctgaagcgaaagtacaagacgcttgacgcgctcaaccacgcatggtggacgccgttttggagccacacgtatacggattggtcgcagatcgagtcgcccatgccgcacggcgagacgtcgattcacgggctgaacctcgactggaagcggttcgtgacggatcagacggtcgacttctgccgccatgagattgagcccctcaaacaggtgaatccgaatcttccagtcaccaccaacttcatgggcacgtatccaggcctcaactactggcgcttccgcgacgtgctcgacgtcatctcgtgggacagctatccgcgctggcacgcgcacgagacgctcgtcccggaggcggtgcacaccgccatggtgcacgatctcaaccgctccatcctcaagaagccatttctgctcatggagtccacgccgagcgtcaccaactggcaggcggtgagcaaacagaagcgccccggcgtgcacgtgctcgtctccctccaggccgtcgcgcacggcgccgattcggtgcagtacttccagtggcgcaaaagccgcggatcgtatgaaaaattccacggcgccgtggtcgatcacgtcggccacgccaacacccgggtgttccgcgacgtgcaagccgtcggcgagatgctggagcggcttgcgccgatggccggcgcggaggtgaaggcggacgcggccgtcatcttcgactgggagaaccgctgggcgctcgaggacgcgaagggcccgcggaacatcggcatgcactacgaggagacggtcgtgaaccactacgcggcgctttggcgcatgggcgtgccgatggacgtgatcgacgaggaacagccgcttgacgggtacaaactggtcgtcgcgccgatgctctacatggtgcgccccggcgtggccgagcggatgaaggcgttcgtcgagcggggcgggtcgctcgtcctcacgtactggtccggcatcgtggatgagaacgatctcgtctttttgggcggcttcccgggcccgctgcgcgaacttgcgggcgtgtgggctgaggagatcgacgcgctgtacgacggcgagcgggtgccggttcgagttgccgacggcaatccgcttggcctcgcgggccactacgaggcgcgcgaactgtgcgaggtggttcacctcgagggcgcggaacccatcgcggtgtacggcgcggactactacgagggcatgcccgcggcaacggttcaccgcgtgggaaagggcaaggtctactacgtggccgcgcggctcgaggacgcgtttttgcgcgatttctttgctcgcgtggctgcggaagccggcgtggcgcgcgccatcgagcgggagctgccggatggcgtaagcgcgatggtgcgctcgggagatggcgtggagtacgtcatgctcatgaacttcacgcccgaggcgcgcgaggtggcgctcgatgaagcggagtacaagccactctatggagaagcgccgacagacggcgcggttcggctccccgcctacggtgtgagcgtgctcgagcgaccggcgcgaaatgggtga

SEQ ID NO: 337 - protein, 798 aa, Alicyclobacillus acidocaldarius
MNVKAASAPDEQRRLPVTPVYLDPAQSIEARVDALLADMTLEEKVAQLTSIWAFEVLDELEFSAEKAAAVLGQGIGQVTRIGGATNLDPPDVARLANQIQRYLRDHTRLGIPALIHEESCSGYMAKGATCFPQTIGIASTWDVDLARRIGAIIRDQMRAVGARQALAPLLDVARDPRWGRVEETFGEDPYLVAQMGIAYVRGLQGDDLSQGVMATGKHFVGYGASEGGMNWAPAHIPERELREVYLFPFEAAVREAGLGAIMPGYHELDGVPCHDNPGLLRETLRGRWGFQGLVVSDYFAVNQLFEYHQVARDKAEAAALAVRAGVDVELPTRDVYGKPLIEAVARGLVSPAEIDELVRRVLTWKFRLGLFDHPFVDEGAAIAVFDNAEQRQVAREAAEKSMVLLKNDGLLPLAPRGTIAVIGPNAHTTRNLVGDYAYPCHIESLLEQSEDNVFQTPLPSGVKHVDEFILMRTILEAIRHRVGSEAQVVYAKGCDILGGEDAELEEAVALAAKADVAVVVVGDRAGLTDACTTGESRDRATLSLIGRQEELVRRVIATGTKTVVVLVSGRPLAIPDIAERANAVLEAWLPGEEGAEAVAAVLFGDVNPSGKLPITIPRSVGQVPIYYGHKPSGGRSHWKGAYVDESNLPLYPFGHGLSYTAFAYRDLALSPSVLGVHGEVEVSCVIENVGARAGEEVVQLYARDVAADVTRPVKALCGFARVALAPGEKARVRFRVSAHQFGFYNREMRYVVEPGEIEFMVGASSEDIRLRGAVRMDGAVTEIEHEKVYQSAVDVERM

SEQ ID NO: 338 - protein, 781 aa, Alicyclobacillus acidocaldarius
MGMIHEQTDFTTSEAIRPDTLISPPDDWAFLGRPSRFDVDHDGWATVQYDAGVMVGVAALDDTVLRVAYCRSPGEWPTSTPAIVEQMSQRHSWRLVQEERRVQLECVAGWQIQINRDDGTWSIRHLGFGTAVEAITWYKRKKGGALTFASLDNARFYGLGEKPGPLDKRHEAYTMWNSDVYAPHVPEMEALYLSIPFFLRLQDQTAVGIFVDNPGRSRFDFRSRYPDVEISTERGGLDVYFIFGASLKDVIRRYTKLTGRMPMPPKWALGYHQSRYSYETQSEVLSVAQTFVERDIPVDALYLDIHYMDGYRVFTFDERRFPDPARMCDELRKLGVRVVPIVDPGVKQDPEYPVYMDGLAHNHFCQTAEGQVYLGEVWPGLSAFPDFASEEVRAWWGKWHRVYTQMGIEGIWNDMNEPAVFNETKTMDVNVVHRGDGRLYTHGEVHNLYGFWMAEATYRGLKAQLAGKRPFVLTRAGYSGIQRYAAVWTGDNRSFWEHMAMAIPMVLNMGMSGIPLGGPDVGGFAHHASGELLARWTQMGAFFPFFRNHSAMGTHRQEPWAFGPTFEAVIRRAIRLRYRFLPYLYTLAREAHETGLPMMRPLVLEYPDDPNTHHVDDQFLVGSDLLVAPILKPGMAHRMVYLPDGEWIDYETRERYQGRQYILTYAPLDRIPLYVRAGSAIPVNLLERSGETQLGWEIFVDANGRASGRCYEDDGETFSYEDGAYCDRVLQALATSEGTLIECHLVQGSGDGGSLESVVRVFTPDDVREARAQGISFSIHV

SEQ ID NO: 339 - DNA, 2397 bp, Alicyclobacillus acidocaldarius
ttgaatgtgaaggcggcgtcagcgcctgatgagcagaggaggcttcccgtgacacccgtgtatctcgatcccgcacagtccattgaagcgcgcgtcgacgcgctcctggccgatatgacgcttgaagaaaaggtcgctcaactcacgtccatctgggcgttcgaagtcctggatgagctcgagttctccgccgagaaggccgccgccgtgctcgggcagggcatcggacaggtgacccgaattggcggcgccaccaatctggacccgccggatgtggcccgcctcgccaaccagattcagcgctacctgcgcgatcacacgcgcctcggcattccggcgctgatccacgaggagtcgtgcagcggctacatggccaagggcgccacctgctttccgcaaaccattggcatcgcgagcacgtgggatgtcgatctcgcccgccgtattggcgccatcatccgcgatcagatgcgggccgtcggggcgcgccaggcgctcgccccgctcctggatgtggcacgagatccgcgctggggccgggtggaggagacgttcggcgaagatccgtacctcgtggcgcagatgggcatcgcgtacgtccgcgggctgcagggagacgacctgagccagggcgtgatggcgacgggcaagcacttcgtgggctacggggcgtccgagggcggcatgaactgggcgccggcgcacatcccggagcgcgagctgcgcgaggtgtacctgttcccgttcgaggcggcggtgcgcgaggcggggctcggcgccatcatgccggggtaccacgagctcgacggcgtgccctgccacgacaatccagggcttttgcgcgagaccctccgcgggcgctggggctttcaggggctcgtggtgtcggactatttcgccgtgaatcagctgttcgaatatcatcaggtggcccgggacaaggcggaggccgcggcgctcgccgtgcgcgccggggtggacgtggagctgccgacgcgcgacgtgtacggcaagccgctcatcgaggccgttgcacgagggctcgtcagcccggccgagatcgacgaactcgtgcgccgggtgctcacgtggaagttccggctcggcctcttcgatcacccgtttgtcgacgagggcgcggccatcgccgtcttcgacaacgcggagcagcgtcaggtggcgcgggaggcggcggagaagtcgatggtcctcctcaaaaacgacgggcttctgcccctcgcgccccgcggcaccatcgccgtgatcggcccaaacgcgcacacgacgcgcaatttggtaggcgattacgcctacccgtgccacatcgagtcgctcctcgagcagtccgaggacaacgtgtttcagaccccgcttccgagcggcgtgaaacacgtggacgagttcatcctcatgcggaccatcctcgaggccatccgccatcgcgtcgggtcggaggcgcaggtcgtctacgcgaaggggtgcgacatcctcggcggtgaggatgcggagctcgaggaggcggtggcgcttgccgcgaaggcggacgtggcggttgtggtggtgggcgatcgcgccgggctcacggacgcgtgcacgacaggggaatcgcgagacagagccacgctctcgctcatcgggcggcaggaggaactcgtgcggcgcgtaatcgccacgggcacgaagacggtcgtggtgctcgtgagcgggcggccgctcgccatcccggacatcgcggagcgggcgaacgccgttctcgaggcgtggctgccgggcgaggaaggcgcggaggcggtggccgcggtcctgtttggcgacgtgaatccgtccgggaagctgcccatcacgattccgcgcagcgtgggccaggtgccaatttactacgggcacaagccgtcgggcggccgctcgcactggaagggcgcgtatgtggacgagagcaatctgccgctctatccgtttgggcacgggctgtcctacacggcgttcgcgtaccgggatctggcgctgtctccgagcgtcctgggcgtgcacggcgaggtcgaggtgtcgtgcgtgatcgaaaacgtcggggctcgcgcgggcgaagaggtggtgcaactgtacgcacgcgacgtggcggcggacgtgacgcggccggtgaaggcgctctgcggctttgcgcgggtggcgctcgcgccgggagagaaggcgcgagtgcggttccgggtttcagcgcaccagttcggcttctacaaccgggagatgcggtatgtcgtggagccgggcgagatcgagttcatggtgggggcgtcgtccgaggacatccgcctgcgcggggcggtgcggatggacggcgcggtgacggagatcgagcacgagaaggtataccagagcgcggtggacgtcgagcggatgtga

SEQ ID NO: 340 - DNA, 2346 bp, Alicyclobacillus acidocaldarius
gtgggcatgattcacgagcagacggatttcacaaccagtgaggcgatccgcccggatacgctgatctcgccgccagatgactgggcttttctcgggcgacccagccggtttgatgtggatcacgatggctgggcgacggttcagtatgacgctggagtcatggtcggtgtcgccgcactcgacgacaccgtgctacgcgtagcctactgcaggtcccctggggagtggccgacgagcacacctgccattgtggaacagatgtcgcagcggcactcctggcggctcgttcaggaagagcgacgcgtgcaactggaatgtgttgccggatggcagattcaaatcaaccgggacgacggaacatggagtatacgccatctcggctttgggacagccgtcgaggccatcacgtggtacaagcgcaaaaaaggcggcgcattgacgtttgcttcgctcgacaatgcccggttctatggacttggcgaaaagccggggccccttgacaagcggcacgaggcgtacaccatgtggaattcggacgtttacgcgcctcacgtgccagagatggaggccctatacctgtcgatcccgttctttttgcgattgcaagaccaaacggccgttggcatctttgtggataatccagggcgatcccgctttgacttcaggagcagataccctgacgtggaaatatcgacagaacgaggcgggttggacgtttatttcatcttcggggcttcgctcaaagatgtcattcgacgttacacaaagctcacggggcgaatgccgatgccacccaagtgggcgctcggctatcatcagtctcggtactcgtacgagacccagagcgaggtcctgtcggtggcgcaaacgtttgtcgagcgcgacattccggtggatgccttgtatctggatattcactacatggatggatatcgggtgttcacctttgatgagaggcgatttcccgatccggcacgcatgtgcgacgagttgcggaagcttggggtgcgcgttgtccccatcgtggatccgggggtgaaacaggatcctgaatatcccgtttacatggacgggctagcccacaaccacttctgccaaaccgccgagggtcaagtgtatcttggtgaggtatggcccggattgagtgcctttcctgatttcgcgtcggaggaagtgcgggcgtggtggggcaagtggcatcgggtgtacacccagatgggaattgagggcatatggaatgatatgaacgagccggctgtgttcaatgagacgaagaccatggacgtgaacgtggtccaccgaggcgacggacgattgtacacgcacggagaggtccacaacctctatggattctggatggctgaagccacgtatcgcggactgaaagcgcagttggctggcaagcggccttttgtgctcacgcgcgctggctacagcggaattcaacggtatgcggcggtgtggacgggcgacaaccgaagcttttgggaacatatggccatggccatcccgatggtgctcaacatggggatgtccggtattccgctcgggggcccagatgtgggcggtttcgctcatcacgcttcaggtgaattgcttgcacgatggacgcaaatgggggcgttctttccgttctttcgaaatcacagtgccatgggaacgcatcgacaggaaccttgggcattcggccctacgttcgaagccgtcattcgacgtgccatccggctccgttatcgtttcctgccttatctgtacacgctcgcacgggaagcccatgagacaggtttacccatgatgcggcccttggtgttagagtatcccgacgatccaaacacgcaccacgtcgatgatcagttcctcgtcggttccgatcttctcgtggcacccatcctcaagccgggcatggcccatagaatggtctatttgcccgatggagaatggattgattatgagacgcgtgagcgataccaagggcgtcagtacatcttgacgtatgcgcctctcgatcgtatccctctgtacgtgagggcagggagcgctatccccgtgaacctcttggagcggtcgggcgagacccagctaggatgggagatcttcgtggacgccaacggtcgagcctcgggtcgatgctatgaggacgacggcgagacgtttagctatgaagacggcgcctactgtgatcgcgtgttacaggccctcgccacctcggaaggaacactgatcgaatgtcatcttgttcaaggatcaggagatggtggaagtctcgagagcgttgttcgcgtgttcacaccagatgacgttcgtgaggctcgtgcgcagggcatatcgttttccatccatgtgtga

What is claimed is:

1. A method of altering enzymatic activity of an extremophilic enzyme, the method comprising:
   introducing a nucleic acid encoding a polypeptide having at least 90% identity to SEQ ID NO:
   307 into *Alicyclobacillus acidocaldarius* or *Pichia pastoris*;
   allowing the *Alicyclobacillus acidocaldarius* or *Pichia pastoris* to express the polypeptide; and
   allowing the *Alicyclobacillus acidocaldarius* or *Pichia pastoris* to glycosylate the polypeptide;
   wherein the glycosylated polypeptide has altered enzymatic activity relative to a non-glycosylated form of the polypeptide; and
   wherein the polypeptide has activity as a xylanase.

2. The method according to claim 1, wherein the glycosylated extremophilic enzyme has altered xylanase activity compared to a non-glycosylated form of the extremophilic enzyme at a pH selected from the group consisting of a pH of less than about 5, about 3.5, and about 2 or at a temperature selected from the group consisting of less than about 90° C., about 90° C., about 80° C., about 70° C., about 60° C., and about 50° C.

* * * * *